US012473543B2

(12) United States Patent
Liu et al.

(10) Patent No.: US 12,473,543 B2
(45) Date of Patent: Nov. 18, 2025

(54) ADENINE BASE EDITORS WITH REDUCED OFF-TARGET EFFECTS

(71) Applicants: The Broad Institute, Inc., Cambridge, MA (US); President and Fellows of Harvard College, Cambridge, MA (US)

(72) Inventors: David R. Liu, Cambridge, MA (US); Holly A. Rees, Cambridge, MA (US)

(73) Assignees: The Broad Institute, Inc., Cambridge, MA (US); President and Fellows of Harvard College, Cambridge, MA (US)

( * ) Notice: Subject to any disclaimer, the term of this patent is extended or adjusted under 35 U.S.C. 154(b) by 767 days.

(21) Appl. No.: 17/603,917

(22) PCT Filed: Apr. 16, 2020

(86) PCT No.: PCT/US2020/028568

§ 371 (c)(1),
(2) Date: Oct. 14, 2021

(87) PCT Pub. No.: WO2020/214842

PCT Pub. Date: Oct. 22, 2020

(65) Prior Publication Data

US 2022/0307003 A1 Sep. 29, 2022

Related U.S. Application Data

(60) Provisional application No. 62/835,490, filed on Apr. 17, 2019.

(51) Int. Cl.
*C12N 9/78* (2006.01)
*C12N 9/22* (2006.01)
*C12N 15/10* (2006.01)

(52) U.S. Cl.
CPC ................. *C12N 9/78* (2013.01); *C12N 9/22* (2013.01); *C12N 15/102* (2013.01); *C07K 2319/09* (2013.01); *C07K 2319/80* (2013.01); *C12N 2310/20* (2017.05); *C12N 2320/31* (2013.01)

(58) Field of Classification Search
CPC ........ C07K 2319/00; C12N 9/22; C12N 9/78; C12N 15/102
See application file for complete search history.

(56) References Cited

U.S. PATENT DOCUMENTS 4,182,449 A 1/1980 Kozlow
4,186,183 A 1/1980 Steck et al.
4,217,344 A 8/1980 Vanlerberghe et al.
4,235,871 A 11/1980 Papahadjopoulos et al.
4,261,975 A 4/1981 Fullerton et al.
4,485,054 A 11/1984 Mezei et al.
4,501,728 A 2/1985 Geho et al.
4,663,290 A 5/1987 Weis et al.
4,737,323 A 4/1988 Martin et al.
4,774,085 A 9/1988 Fidler
4,797,368 A 1/1989 Carter et al.
4,837,028 A 6/1989 Allen
4,873,316 A 10/1989 Meade et al.
4,880,635 A 11/1989 Janoff et al.
4,889,818 A 12/1989 Gelfand et al.
4,897,355 A 1/1990 Eppstein et al.
4,906,477 A 3/1990 Kurono et al.
4,911,928 A 3/1990 Wallach
4,917,951 A 4/1990 Wallach
4,920,016 A 4/1990 Allen et al.
4,921,757 A 5/1990 Wheatley et al.
4,946,787 A 8/1990 Eppstein et al.
4,965,185 A 10/1990 Grischenko et al.
5,017,492 A 5/1991 Kotewicz et al.
5,047,342 A 9/1991 Chatterjee
5,049,386 A 9/1991 Eppstein et al.
5,079,352 A 1/1992 Gelfand et al.
5,139,941 A 8/1992 Muzyczka et al.
5,173,414 A 12/1992 Lebkowski et al.
5,223,409 A 6/1993 Ladner et al.
5,244,797 A 9/1993 Kotewicz et al.
5,270,179 A 12/1993 Chatterjee
5,374,553 A 12/1994 Gelfand et al.
5,405,776 A 4/1995 Kotewicz et al.
5,436,149 A 7/1995 Barnes
5,449,639 A 9/1995 Wei et al.
5,478,745 A 12/1995 Samulski et al.
5,496,714 A 3/1996 Comb et al.
5,512,462 A 4/1996 Cheng
5,580,737 A 12/1996 Polisky et al.
5,614,365 A 3/1997 Tabor et al.
5,652,094 A 7/1997 Usman et al.
5,658,727 A 8/1997 Barbas et al.
(Continued)

FOREIGN PATENT DOCUMENTS

AU 2012244264 A1 11/2012
AU 2015252023 A1 11/2015
(Continued)

OTHER PUBLICATIONS

Kim et al., Biochemistry, 2006, 45, pp. 6407-6416 (Year: 2006).*
(Continued)

*Primary Examiner* — Thea D'Ambrosio
*Assistant Examiner* — Claudia Espinosa
(74) *Attorney, Agent, or Firm* — Wolf, Greenfield & Sacks, P.C.

(57) ABSTRACT

The present disclosure provides novel adenine base editors that retain ability to edit DNA efficiently but show greatly reduced off-target effects, such as reduced RNA editing activity, as well as lower off-target DNA editing activity and reduced indel by product formation. Also provided are base editing methods comprising contacting a nucleic acid molecule with an adenine base editor and a guide RNA that has complementarity to a target sequence. Further provided are complexes comprising a guide RNA bound to a base editor provided herein; and kits and pharmaceutical compositions for the administration of adenine base editor variants to a host cell.

22 Claims, 26 Drawing Sheets

Specification includes a Sequence Listing.

(56) References Cited

U.S. PATENT DOCUMENTS

| | | | |
|---|---|---|---|
| 5,668,005 | A | 9/1997 | Kotewicz et al. |
| 5,677,152 | A | 10/1997 | Birch et al. |
| 5,767,099 | A | 6/1998 | Harris et al. |
| 5,780,053 | A | 7/1998 | Ashley et al. |
| 5,830,430 | A | 11/1998 | Unger et al. |
| 5,834,247 | A | 11/1998 | Comb et al. |
| 5,835,699 | A | 11/1998 | Kimura |
| 5,844,075 | A | 12/1998 | Kawakami et al. |
| 5,849,548 | A | 12/1998 | Haseloff et al. |
| 5,851,548 | A | 12/1998 | Dattagupta et al. |
| 5,855,910 | A | 1/1999 | Ashley et al. |
| 5,856,463 | A | 1/1999 | Blankenborg et al. |
| 5,962,313 | A | 10/1999 | Podsakoff et al. |
| 5,981,182 | A | 11/1999 | Jacobs, Jr. et al. |
| 6,015,794 | A | 1/2000 | Haseloff et al. |
| 6,057,153 | A | 5/2000 | George et al. |
| 6,063,608 | A | 5/2000 | Kotewicz et al. |
| 6,077,705 | A | 6/2000 | Duan et al. |
| 6,099,857 | A | 8/2000 | Gross |
| 6,156,509 | A | 12/2000 | Schellenberger |
| 6,183,998 | B1 | 2/2001 | Ivanov et al. |
| 6,355,415 | B1 | 3/2002 | Wagner et al. |
| 6,416,997 | B1 | 7/2002 | Mir-Shekari et al. |
| 6,429,298 | B1 | 8/2002 | Ellington et al. |
| 6,453,242 | B1 | 9/2002 | Eisenberg et al. |
| 6,479,264 | B1 | 11/2002 | Louwrier |
| 6,503,717 | B2 | 1/2003 | Case et al. |
| 6,534,261 | B1 | 3/2003 | Cox, III et al. |
| 6,558,671 | B1 | 5/2003 | Slingluff et al. |
| 6,589,768 | B1 | 7/2003 | Kotewicz et al. |
| 6,599,692 | B1 | 7/2003 | Case et al. |
| 6,607,882 | B1 | 8/2003 | Cox, III et al. |
| 6,610,522 | B1 | 8/2003 | Kotewicz et al. |
| 6,689,558 | B2 | 2/2004 | Case et al. |
| 6,716,973 | B2 | 4/2004 | Baskerville et al. |
| 6,824,978 | B1 | 11/2004 | Cox, III et al. |
| 6,933,113 | B2 | 8/2005 | Case et al. |
| 6,979,539 | B2 | 12/2005 | Cox, III et al. |
| 7,013,219 | B2 | 3/2006 | Case et al. |
| 7,045,337 | B2 | 5/2006 | Schultz et al. |
| 7,067,650 | B1 | 6/2006 | Tanaka |
| 7,070,928 | B2 | 7/2006 | Liu et al. |
| 7,078,208 | B2 | 7/2006 | Smith et al. |
| 7,083,970 | B2 | 8/2006 | Schultz et al. |
| 7,163,824 | B2 | 1/2007 | Cox, III et al. |
| 7,192,739 | B2 | 3/2007 | Liu et al. |
| 7,223,545 | B2 | 5/2007 | Liu et al. |
| 7,329,807 | B2 | 2/2008 | Vadrucci et al. |
| 7,354,761 | B2 | 4/2008 | Schultz et al. |
| 7,368,275 | B2 | 5/2008 | Schultz et al. |
| 7,419,669 | B2 | 9/2008 | Kosmatopoulos et al. |
| 7,442,160 | B2 | 10/2008 | Liu et al. |
| 7,476,500 | B1 | 1/2009 | Liu et al. |
| 7,476,734 | B2 | 1/2009 | Liu |
| 7,479,573 | B2 | 1/2009 | Chu et al. |
| 7,488,718 | B2 | 2/2009 | Scheinberg et al. |
| 7,491,494 | B2 | 2/2009 | Liu et al. |
| 7,510,706 | B2 | 3/2009 | Yonemitsu et al. |
| 7,541,450 | B2 | 6/2009 | Liu et al. |
| 7,556,940 | B2 | 7/2009 | Galarza et al. |
| 7,557,068 | B2 | 7/2009 | Liu et al. |
| 7,595,179 | B2 | 9/2009 | Chen et al. |
| 7,638,300 | B2 | 12/2009 | Schultz et al. |
| 7,670,807 | B2 | 3/2010 | Lampson et al. |
| 7,678,554 | B2 | 3/2010 | Liu et al. |
| 7,713,721 | B2 | 5/2010 | Schultz et al. |
| 7,771,935 | B2 | 8/2010 | Liu et al. |
| 7,794,931 | B2 | 9/2010 | Breaker et al. |
| 7,807,408 | B2 | 10/2010 | Liu et al. |
| 7,851,658 | B2 | 12/2010 | Liu et al. |
| 7,915,025 | B2 | 3/2011 | Schultz et al. |
| 7,919,277 | B2 | 4/2011 | Russell et al. |
| 7,993,672 | B2 | 8/2011 | Huang et al. |
| 7,998,904 | B2 | 8/2011 | Liu et al. |
| 7,999,071 | B2 | 8/2011 | Schlom et al. |
| 8,012,739 | B2 | 9/2011 | Schultz et al. |
| 8,017,323 | B2 | 9/2011 | Liu et al. |
| 8,017,755 | B2 | 9/2011 | Liu et al. |
| 8,030,074 | B2 | 10/2011 | Schultz et al. |
| 8,067,556 | B2 | 11/2011 | Hogrefe et al. |
| 8,114,648 | B2 | 2/2012 | Schultz et al. |
| 8,173,364 | B2 | 5/2012 | Schultz et al. |
| 8,173,392 | B2 | 5/2012 | Schultz et al. |
| 8,183,012 | B2 | 5/2012 | Schultz et al. |
| 8,183,178 | B2 | 5/2012 | Liu et al. |
| 8,206,914 | B2 | 6/2012 | Liu et al. |
| 8,354,380 | B2 | 1/2013 | Liu et al. |
| 8,361,725 | B2 | 1/2013 | Russell et al. |
| 8,394,604 | B2 | 3/2013 | Liu et al. |
| 8,420,104 | B2 | 4/2013 | Charneau et al. |
| 8,440,431 | B2 | 5/2013 | Voytas et al. |
| 8,440,432 | B2 | 5/2013 | Voytas et al. |
| 8,450,471 | B2 | 5/2013 | Voytas et al. |
| 8,492,082 | B2 | 7/2013 | De Franciscis et al. |
| 8,546,553 | B2 | 10/2013 | Terns et al. |
| 8,569,256 | B2 | 10/2013 | Heyes et al. |
| 8,586,363 | B2 | 11/2013 | Voytas et al. |
| 8,673,612 | B2 | 3/2014 | Klatzmann et al. |
| 8,680,069 | B2 | 3/2014 | de Fougerolles et al. |
| 8,691,729 | B2 | 4/2014 | Liu et al. |
| 8,691,750 | B2 | 4/2014 | Constien et al. |
| 8,697,359 | B1 | 4/2014 | Zhang |
| 8,697,439 | B2 | 4/2014 | Mangeot et al. |
| 8,697,853 | B2 | 4/2014 | Voytas et al. |
| 8,709,466 | B2 | 4/2014 | Coady et al. |
| 8,728,526 | B2 | 5/2014 | Heller |
| 8,729,038 | B2 | 5/2014 | Gruber et al. |
| 8,741,279 | B2 | 6/2014 | Kasahara et al. |
| 8,748,667 | B2 | 6/2014 | Budzik et al. |
| 8,758,810 | B2 | 6/2014 | Okada et al. |
| 8,759,103 | B2 | 6/2014 | Kim et al. |
| 8,759,104 | B2 | 6/2014 | Unciti-Broceta et al. |
| 8,771,728 | B2 | 7/2014 | Huang et al. |
| 8,790,664 | B2 | 7/2014 | Pitard et al. |
| 8,795,965 | B2 | 8/2014 | Zhang |
| 8,822,663 | B2 | 9/2014 | Schrum et al. |
| 8,835,148 | B2 | 9/2014 | Janulaitis et al. |
| 8,846,578 | B2 | 9/2014 | McCray et al. |
| 8,871,445 | B2 | 10/2014 | Cong et al. |
| 8,889,418 | B2 | 11/2014 | Zhang et al. |
| 8,900,814 | B2 | 12/2014 | Yasukawa et al. |
| 8,945,839 | B2 | 2/2015 | Zhang |
| 8,975,232 | B2 | 3/2015 | Liu et al. |
| 8,993,233 | B2 | 3/2015 | Zhang et al. |
| 8,999,641 | B2 | 4/2015 | Zhang et al. |
| 9,023,594 | B2 | 5/2015 | Liu et al. |
| 9,023,649 | B2 | 5/2015 | Mali et al. |
| 9,034,650 | B2 | 5/2015 | Padidam |
| 9,068,179 | B1 | 6/2015 | Liu et al. |
| 9,150,626 | B2 | 10/2015 | Liu et al. |
| 9,163,271 | B2 | 10/2015 | Schultz et al. |
| 9,163,284 | B2 | 10/2015 | Liu et al. |
| 9,181,535 | B2 | 11/2015 | Liu et al. |
| 9,200,045 | B2 | 12/2015 | Liu et al. |
| 9,221,886 | B2 | 12/2015 | Liu et al. |
| 9,228,207 | B2 | 1/2016 | Liu et al. |
| 9,234,213 | B2 | 1/2016 | Wu |
| 9,243,038 | B2 | 1/2016 | Liu et al. |
| 9,267,127 | B2 | 2/2016 | Liu et al. |
| 9,290,773 | B2 | 3/2016 | Edgerton |
| 9,296,790 | B2 | 3/2016 | Chatterjee et al. |
| 9,322,006 | B2 | 4/2016 | Liu et al. |
| 9,322,037 | B2 | 4/2016 | Liu et al. |
| 9,340,799 | B2 | 5/2016 | Liu et al. |
| 9,340,800 | B2 | 5/2016 | Liu et al. |
| 9,359,599 | B2 | 6/2016 | Liu et al. |
| 9,388,430 | B2 | 7/2016 | Liu et al. |
| 9,394,537 | B2 | 7/2016 | Liu et al. |
| 9,434,774 | B2 | 9/2016 | Liu et al. |
| 9,458,484 | B2 | 10/2016 | Ma et al. |
| 9,512,446 | B1 | 12/2016 | Joung et al. |
| 9,526,784 | B2 | 12/2016 | Liu et al. |
| 9,534,210 | B2 | 1/2017 | Park et al. |
| 9,580,698 | B1 | 2/2017 | Xu et al. |

(56) References Cited

U.S. PATENT DOCUMENTS

| | | | |
|---|---|---|---|
| 9,593,356 | B2 | 3/2017 | Haugwitz et al. |
| 9,610,322 | B2 | 4/2017 | Liu et al. |
| 9,637,739 | B2 | 5/2017 | Siksnys et al. |
| 9,663,770 | B2 | 5/2017 | Rogers et al. |
| 9,695,446 | B2 | 7/2017 | Mangeot et al. |
| 9,737,604 | B2 | 8/2017 | Jin et al. |
| 9,738,693 | B2 | 8/2017 | Telford et al. |
| 9,753,340 | B2 | 9/2017 | Saitou |
| 9,765,304 | B2 | 9/2017 | Klatzmann et al. |
| 9,771,574 | B2 | 9/2017 | Liu et al. |
| 9,777,043 | B2 | 10/2017 | Anderson et al. |
| 9,783,791 | B2 | 10/2017 | Hogrefe et al. |
| 9,816,093 | B1 | 11/2017 | Donohoue et al. |
| 9,840,538 | B2 | 12/2017 | Telford et al. |
| 9,840,690 | B2 | 12/2017 | Karli et al. |
| 9,840,699 | B2 | 12/2017 | Liu et al. |
| 9,840,702 | B2 | 12/2017 | Collingwood et al. |
| 9,850,521 | B2 | 12/2017 | Braman et al. |
| 9,873,907 | B2 | 1/2018 | Zeiner et al. |
| 9,879,270 | B2 | 1/2018 | Hittinger et al. |
| 9,914,939 | B2 | 3/2018 | Church et al. |
| 9,932,567 | B1 | 4/2018 | Xu et al. |
| 9,938,288 | B1 | 4/2018 | Kishi et al. |
| 9,944,933 | B2 | 4/2018 | Storici et al. |
| 9,982,279 | B1 | 5/2018 | Gill et al. |
| 9,999,671 | B2 | 6/2018 | Liu et al. |
| 10,011,868 | B2 | 7/2018 | Liu et al. |
| 10,040,830 | B2 | 8/2018 | Chatterjee et al. |
| 10,053,725 | B2 | 8/2018 | Liu et al. |
| 10,059,940 | B2 | 8/2018 | Zhong |
| 10,077,453 | B2 | 9/2018 | Liu et al. |
| 10,113,163 | B2 | 10/2018 | Liu et al. |
| 10,150,955 | B2 | 12/2018 | Lambowitz et al. |
| 10,167,457 | B2 | 1/2019 | Liu et al. |
| 10,179,911 | B2 | 1/2019 | Liu et al. |
| 10,189,831 | B2 | 1/2019 | Arrington et al. |
| 10,202,593 | B2 | 2/2019 | Liu et al. |
| 10,202,658 | B2 | 2/2019 | Parkin et al. |
| 10,227,581 | B2 | 3/2019 | Liu et al. |
| 10,323,236 | B2 | 6/2019 | Liu et al. |
| 10,336,997 | B2 | 7/2019 | Liu et al. |
| 10,358,670 | B2 | 7/2019 | Janulaitis et al. |
| 10,392,674 | B2 | 8/2019 | Liu et al. |
| 10,407,474 | B2 | 9/2019 | Liu et al. |
| 10,407,695 | B2 | 9/2019 | Charneau et al. |
| 10,407,697 | B2 | 9/2019 | Doudna et al. |
| 10,465,176 | B2 | 11/2019 | Liu et al. |
| 10,508,298 | B2 | 12/2019 | Liu et al. |
| 10,583,201 | B2 | 3/2020 | Chen et al. |
| 10,597,679 | B2 | 3/2020 | Liu et al. |
| 10,612,011 | B2 | 4/2020 | Liu et al. |
| 10,640,767 | B2 | 5/2020 | Maianti et al. |
| 10,682,410 | B2 | 6/2020 | Liu et al. |
| 10,704,062 | B2 | 7/2020 | Liu et al. |
| 10,745,677 | B2 | 8/2020 | Maianti et al. |
| 10,858,639 | B2 | 12/2020 | Liu et al. |
| 10,912,833 | B2 | 2/2021 | Liu et al. |
| 10,930,367 | B2 | 2/2021 | Zhang et al. |
| 10,947,530 | B2 | 3/2021 | Liu et al. |
| 10,954,548 | B2 | 3/2021 | Liu et al. |
| 10,968,253 | B2 | 4/2021 | Ohlmann et al. |
| 11,046,948 | B2 | 6/2021 | Liu et al. |
| 11,053,481 | B2 | 7/2021 | Liu et al. |
| 11,124,782 | B2 | 9/2021 | Liu et al. |
| 11,142,760 | B2 | 10/2021 | Slaymaker et al. |
| 11,214,780 | B2 | 1/2022 | Liu et al. |
| 11,268,082 | B2 | 3/2022 | Liu et al. |
| 11,299,755 | B2 | 4/2022 | Liu et al. |
| 11,306,324 | B2 | 4/2022 | Liu et al. |
| 11,319,532 | B2 | 5/2022 | Liu et al. |
| 11,447,770 | B1 | 9/2022 | Liu et al. |
| 11,542,496 | B2 | 1/2023 | Liu et al. |
| 11,542,509 | B2 | 1/2023 | Maianti et al. |
| 11,560,566 | B2 | 1/2023 | Liu et al. |
| 11,578,343 | B2 | 2/2023 | Liu et al. |
| 11,643,652 | B2 | 5/2023 | Liu et al. |
| 11,661,590 | B2 | 5/2023 | Liu et al. |
| 11,702,651 | B2 | 7/2023 | Liu et al. |
| 11,732,274 | B2 | 8/2023 | Liu et al. |
| 11,795,443 | B2 | 10/2023 | Liu et al. |
| 11,795,452 | B2 | 10/2023 | Liu et al. |
| 11,820,969 | B2 | 11/2023 | Maianti et al. |
| 11,898,179 | B2 | 2/2024 | Maianti et al. |
| 11,912,985 | B2 | 2/2024 | Liu et al. |
| 11,920,181 | B2 | 3/2024 | Liu et al. |
| 11,932,884 | B2 | 3/2024 | Liu et al. |
| 11,999,947 | B2 | 6/2024 | Liu et al. |
| 12,006,520 | B2 | 6/2024 | Liu et al. |
| 12,031,126 | B2 | 7/2024 | Liu et al. |
| 12,043,852 | B2 | 7/2024 | Liu et al. |
| 12,084,663 | B2 | 9/2024 | Maianti et al. |
| 12,157,760 | B2 | 12/2024 | Liu et al. |
| 12,215,365 | B2 | 2/2025 | Liu et al. |
| 12,281,303 | B2 | 4/2025 | Liu et al. |
| 12,281,338 | B2 | 4/2025 | Liu et al. |
| 2003/0082575 | A1 | 5/2003 | Schultz et al. |
| 2003/0087817 | A1 | 5/2003 | Cox et al. |
| 2003/0096337 | A1 | 5/2003 | Hillman et al. |
| 2003/0103939 | A1 | 6/2003 | Engelhardt et al. |
| 2003/0108885 | A1 | 6/2003 | Schultz et al. |
| 2003/0119764 | A1 | 6/2003 | Loeb et al. |
| 2003/0167533 | A1 | 9/2003 | Yadav et al. |
| 2003/0203480 | A1 | 10/2003 | Kovesdi et al. |
| 2004/0003420 | A1 | 1/2004 | Kuhn et al. |
| 2004/0028687 | A1 | 2/2004 | Waelti |
| 2004/0115184 | A1 | 6/2004 | Smith et al. |
| 2004/0156861 | A1 | 8/2004 | Figdor et al. |
| 2004/0197892 | A1 | 10/2004 | Moore et al. |
| 2004/0203109 | A1 | 10/2004 | Lal et al. |
| 2005/0100890 | A1 | 5/2005 | Davidson et al. |
| 2005/0136429 | A1 | 6/2005 | Guarente et al. |
| 2005/0222030 | A1 | 10/2005 | Allison |
| 2005/0260626 | A1 | 11/2005 | Lorens et al. |
| 2006/0088864 | A1 | 4/2006 | Smolke et al. |
| 2006/0104984 | A1 | 5/2006 | Littlefield et al. |
| 2006/0216702 | A1 | 9/2006 | Compans et al. |
| 2006/0246568 | A1 | 11/2006 | Honjo et al. |
| 2007/0015238 | A1 | 1/2007 | Snyder et al. |
| 2007/0049533 | A1 | 3/2007 | Liu et al. |
| 2007/0264692 | A1 | 11/2007 | Liu et al. |
| 2007/0269817 | A1 | 11/2007 | Shapero |
| 2007/0298118 | A1 | 12/2007 | Lotvall et al. |
| 2008/0008697 | A1 | 1/2008 | Mintier et al. |
| 2008/0051317 | A1 | 2/2008 | Church et al. |
| 2008/0124725 | A1 | 5/2008 | Barrangou et al. |
| 2008/0182254 | A1 | 7/2008 | Hall et al. |
| 2008/0220502 | A1 | 9/2008 | Schellenberger et al. |
| 2008/0241917 | A1 | 10/2008 | Akita et al. |
| 2008/0268516 | A1 | 10/2008 | Perreault et al. |
| 2009/0111119 | A1 | 4/2009 | Doyon et al. |
| 2009/0130718 | A1 | 5/2009 | Short |
| 2009/0202622 | A1 | 8/2009 | Fleury et al. |
| 2009/0215878 | A1 | 8/2009 | Tan et al. |
| 2009/0234109 | A1 | 9/2009 | Han et al. |
| 2010/0076057 | A1 | 3/2010 | Sontheimer et al. |
| 2010/0093617 | A1 | 4/2010 | Barrangou et al. |
| 2010/0104690 | A1 | 4/2010 | Barrangou et al. |
| 2010/0105134 | A1 | 4/2010 | Quay et al. |
| 2010/0273857 | A1 | 10/2010 | Thakker et al. |
| 2010/0305197 | A1 | 12/2010 | Che |
| 2010/0316643 | A1 | 12/2010 | Eckert et al. |
| 2011/0016540 | A1 | 1/2011 | Weinstein et al. |
| 2011/0059160 | A1 | 3/2011 | Essner et al. |
| 2011/0059502 | A1 | 3/2011 | Chalasani |
| 2011/0104787 | A1 | 5/2011 | Church et al. |
| 2011/0123509 | A1 | 5/2011 | Jantz et al. |
| 2011/0177495 | A1 | 7/2011 | Liu et al. |
| 2011/0189775 | A1 | 8/2011 | Ainley et al. |
| 2011/0189776 | A1 | 8/2011 | Terns et al. |
| 2011/0206672 | A1 | 8/2011 | Little |
| 2011/0217739 | A1 | 9/2011 | Terns et al. |
| 2011/0301073 | A1 | 12/2011 | Gregory et al. |
| 2012/0129759 | A1 | 5/2012 | Liu et al. |
| 2012/0141523 | A1 | 6/2012 | Castado et al. |

(56) References Cited

U.S. PATENT DOCUMENTS

| | | | |
|---|---|---|---|
| 2012/0159653 | A1 | 6/2012 | Weinstein et al. |
| 2012/0244601 | A1 | 9/2012 | Bertozzi et al. |
| 2012/0270273 | A1 | 10/2012 | Zhang et al. |
| 2012/0322861 | A1 | 12/2012 | Byrne et al. |
| 2013/0022980 | A1 | 1/2013 | Nelson et al. |
| 2013/0053426 | A1 | 2/2013 | Seow et al. |
| 2013/0059931 | A1 | 3/2013 | Petersen-Mahrt et al. |
| 2013/0108657 | A1 | 5/2013 | Yee et al. |
| 2013/0117869 | A1 | 5/2013 | Duchateau et al. |
| 2013/0130248 | A1 | 5/2013 | Haurwitz et al. |
| 2013/0158245 | A1 | 6/2013 | Russell et al. |
| 2013/0165389 | A1 | 6/2013 | Schellenberger et al. |
| 2013/0212725 | A1 | 8/2013 | Kuhn et al. |
| 2013/0309720 | A1 | 11/2013 | Schultz et al. |
| 2013/0344117 | A1 | 12/2013 | Mirosevich et al. |
| 2013/0345064 | A1 | 12/2013 | Liu et al. |
| 2014/0004280 | A1 | 1/2014 | Loomis |
| 2014/0005269 | A1 | 1/2014 | Ngwuluka et al. |
| 2014/0017214 | A1 | 1/2014 | Cost |
| 2014/0018404 | A1 | 1/2014 | Chen et al. |
| 2014/0044793 | A1 | 2/2014 | Goll et al. |
| 2014/0065711 | A1 | 3/2014 | Liu et al. |
| 2014/0068797 | A1 | 3/2014 | Doudna et al. |
| 2014/0127752 | A1 | 5/2014 | Zhou et al. |
| 2014/0128449 | A1 | 5/2014 | Liu et al. |
| 2014/0141094 | A1 | 5/2014 | Smyth et al. |
| 2014/0141487 | A1 | 5/2014 | Feldman et al. |
| 2014/0179770 | A1 | 6/2014 | Zhang et al. |
| 2014/0186843 | A1 | 7/2014 | Zhang et al. |
| 2014/0186919 | A1 | 7/2014 | Zhang et al. |
| 2014/0186958 | A1 | 7/2014 | Zhang et al. |
| 2014/0201858 | A1 | 7/2014 | Ostertag et al. |
| 2014/0234289 | A1 | 8/2014 | Liu et al. |
| 2014/0248702 | A1 | 9/2014 | Zhang et al. |
| 2014/0273037 | A1 | 9/2014 | Wu |
| 2014/0273226 | A1 | 9/2014 | Wu |
| 2014/0273230 | A1 | 9/2014 | Chen et al. |
| 2014/0273234 | A1 | 9/2014 | Zhang et al. |
| 2014/0283156 | A1 | 9/2014 | Zador et al. |
| 2014/0295556 | A1 | 10/2014 | Joung et al. |
| 2014/0295557 | A1 | 10/2014 | Joung et al. |
| 2014/0342456 | A1 | 11/2014 | Mali et al. |
| 2014/0342457 | A1 | 11/2014 | Mali et al. |
| 2014/0342458 | A1 | 11/2014 | Mali et al. |
| 2014/0349400 | A1 | 11/2014 | Jakimo et al. |
| 2014/0356867 | A1 | 12/2014 | Peter et al. |
| 2014/0356956 | A1 | 12/2014 | Church et al. |
| 2014/0356958 | A1 | 12/2014 | Mali et al. |
| 2014/0356959 | A1 | 12/2014 | Church et al. |
| 2014/0357523 | A1 | 12/2014 | Zeiner et al. |
| 2014/0377868 | A1 | 12/2014 | Joung et al. |
| 2015/0010526 | A1 | 1/2015 | Liu et al. |
| 2015/0031089 | A1 | 1/2015 | Lindstrom |
| 2015/0031132 | A1 | 1/2015 | Church et al. |
| 2015/0031133 | A1 | 1/2015 | Church et al. |
| 2015/0044191 | A1 | 2/2015 | Liu et al. |
| 2015/0044192 | A1 | 2/2015 | Liu et al. |
| 2015/0044772 | A1 | 2/2015 | Zhao |
| 2015/0050699 | A1 | 2/2015 | Siksnys et al. |
| 2015/0056177 | A1 | 2/2015 | Liu et al. |
| 2015/0056629 | A1 | 2/2015 | Guthrie-Honea |
| 2015/0064138 | A1 | 3/2015 | Lu et al. |
| 2015/0064789 | A1 | 3/2015 | Paschon et al. |
| 2015/0071898 | A1 | 3/2015 | Liu et al. |
| 2015/0071899 | A1 | 3/2015 | Liu et al. |
| 2015/0071900 | A1 | 3/2015 | Liu et al. |
| 2015/0071901 | A1 | 3/2015 | Liu et al. |
| 2015/0071902 | A1 | 3/2015 | Liu et al. |
| 2015/0071903 | A1 | 3/2015 | Liu et al. |
| 2015/0071906 | A1 | 3/2015 | Liu et al. |
| 2015/0079680 | A1 | 3/2015 | Bradley et al. |
| 2015/0079681 | A1 | 3/2015 | Zhang |
| 2015/0098954 | A1 | 4/2015 | Hyde et al. |
| 2015/0118216 | A1 | 4/2015 | Liu et al. |
| 2015/0128300 | A1 | 5/2015 | Warming et al. |
| 2015/0132269 | A1 | 5/2015 | Orkin et al. |
| 2015/0140664 | A1 | 5/2015 | Byrne et al. |
| 2015/0159172 | A1 | 6/2015 | Miller et al. |
| 2015/0165054 | A1 | 6/2015 | Liu et al. |
| 2015/0166980 | A1 | 6/2015 | Liu et al. |
| 2015/0166981 | A1 | 6/2015 | Liu et al. |
| 2015/0166982 | A1 | 6/2015 | Liu et al. |
| 2015/0166983 | A1 | 6/2015 | Liu et al. |
| 2015/0166984 | A1 | 6/2015 | Liu et al. |
| 2015/0166985 | A1 | 6/2015 | Liu et al. |
| 2015/0191744 | A1 | 7/2015 | Wolfe et al. |
| 2015/0197759 | A1 | 7/2015 | Xu et al. |
| 2015/0211058 | A1 | 7/2015 | Carstens |
| 2015/0218573 | A1 | 8/2015 | Loque et al. |
| 2015/0225773 | A1 | 8/2015 | Farmer et al. |
| 2015/0241440 | A1 | 8/2015 | Fasan et al. |
| 2015/0252358 | A1 | 9/2015 | Maeder et al. |
| 2015/0275202 | A1 | 10/2015 | Liu et al. |
| 2015/0291965 | A1 | 10/2015 | Zhang et al. |
| 2015/0307889 | A1 | 10/2015 | Petolino et al. |
| 2015/0315252 | A1 | 11/2015 | Haugwitz et al. |
| 2015/0344549 | A1 | 12/2015 | Muir et al. |
| 2016/0017393 | A1 | 1/2016 | Jacobson et al. |
| 2016/0017396 | A1 | 1/2016 | Cann et al. |
| 2016/0032292 | A1 | 2/2016 | Storici et al. |
| 2016/0032353 | A1 | 2/2016 | Braman et al. |
| 2016/0040155 | A1 | 2/2016 | Maizels et al. |
| 2016/0046952 | A1 | 2/2016 | Hittinger et al. |
| 2016/0046961 | A1 | 2/2016 | Jinek et al. |
| 2016/0046962 | A1 | 2/2016 | May et al. |
| 2016/0053272 | A1 | 2/2016 | Wurtzel et al. |
| 2016/0053304 | A1 | 2/2016 | Wurtzel et al. |
| 2016/0074535 | A1 | 3/2016 | Ranganathan et al. |
| 2016/0076093 | A1 | 3/2016 | Shendure et al. |
| 2016/0090603 | A1 | 3/2016 | Carnes et al. |
| 2016/0090622 | A1 | 3/2016 | Liu et al. |
| 2016/0115488 | A1 | 4/2016 | Zhang et al. |
| 2016/0137716 | A1 | 5/2016 | El Andaloussi et al. |
| 2016/0138046 | A1 | 5/2016 | Wu |
| 2016/0153003 | A1 | 6/2016 | Joung et al. |
| 2016/0186214 | A1 | 6/2016 | Brouns et al. |
| 2016/0200779 | A1 | 7/2016 | Liu et al. |
| 2016/0201040 | A1 | 7/2016 | Liu et al. |
| 2016/0201089 | A1 | 7/2016 | Gersbach et al. |
| 2016/0206566 | A1 | 7/2016 | Lu et al. |
| 2016/0208243 | A1 | 7/2016 | Zhang et al. |
| 2016/0208288 | A1 | 7/2016 | Liu et al. |
| 2016/0215275 | A1 | 7/2016 | Zhong |
| 2016/0215276 | A1 | 7/2016 | Liu et al. |
| 2016/0215300 | A1 | 7/2016 | May et al. |
| 2016/0244784 | A1 | 8/2016 | Jacobson et al. |
| 2016/0244829 | A1 | 8/2016 | Bang et al. |
| 2016/0264934 | A1 | 9/2016 | Giallourakis et al. |
| 2016/0272593 | A1 | 9/2016 | Ritter et al. |
| 2016/0272965 | A1 | 9/2016 | Zhang et al. |
| 2016/0281072 | A1 | 9/2016 | Zhang |
| 2016/0298136 | A1 | 10/2016 | Chen et al. |
| 2016/0304846 | A1 | 10/2016 | Liu et al. |
| 2016/0304855 | A1 | 10/2016 | Stark et al. |
| 2016/0312304 | A1 | 10/2016 | Sorrentino et al. |
| 2016/0319262 | A1 | 11/2016 | Doudna et al. |
| 2016/0333389 | A1 | 11/2016 | Liu et al. |
| 2016/0340622 | A1 | 11/2016 | Abdou |
| 2016/0340661 | A1 | 11/2016 | Cong et al. |
| 2016/0340662 | A1 | 11/2016 | Zhang et al. |
| 2016/0345578 | A1 | 12/2016 | Barrangou et al. |
| 2016/0346360 | A1 | 12/2016 | Quake et al. |
| 2016/0346361 | A1 | 12/2016 | Quake et al. |
| 2016/0346362 | A1 | 12/2016 | Quake et al. |
| 2016/0348074 | A1 | 12/2016 | Quake et al. |
| 2016/0348096 | A1 | 12/2016 | Liu et al. |
| 2016/0350476 | A1 | 12/2016 | Quake et al. |
| 2016/0355796 | A1 | 12/2016 | Davidson et al. |
| 2016/0369262 | A1 | 12/2016 | Reik et al. |
| 2017/0009224 | A1 | 1/2017 | Liu et al. |
| 2017/0009242 | A1 | 1/2017 | McKinley et al. |
| 2017/0014449 | A1 | 1/2017 | Bangera et al. |
| 2017/0020922 | A1 | 1/2017 | Wagner et al. |
| 2017/0022251 | A1 | 1/2017 | Rammensee et al. |

(56) References Cited

U.S. PATENT DOCUMENTS

2017/0037432 A1 2/2017 Donohoue et al.
2017/0044520 A1 2/2017 Liu et al.
2017/0044592 A1 2/2017 Peter et al.
2017/0053729 A1 2/2017 Kotani et al.
2017/0058271 A1 3/2017 Joung et al.
2017/0058272 A1 3/2017 Carter et al.
2017/0058298 A1 3/2017 Kennedy et al.
2017/0073663 A1 3/2017 Wang et al.
2017/0073670 A1 3/2017 Nishida et al.
2017/0087224 A1 3/2017 Quake
2017/0087225 A1 3/2017 Quake
2017/0088587 A1 3/2017 Quake
2017/0088828 A1 3/2017 Quake
2017/0107536 A1 4/2017 Zhang et al.
2017/0107560 A1 4/2017 Peter et al.
2017/0112773 A1 4/2017 Stachowiak et al.
2017/0114367 A1 4/2017 Hu et al.
2017/0121693 A1 5/2017 Liu et al.
2017/0145394 A1 5/2017 Yeo et al.
2017/0145405 A1 5/2017 Tang et al.
2017/0145438 A1 5/2017 Kantor
2017/0152528 A1 6/2017 Zhang
2017/0152787 A1 6/2017 Kubo et al.
2017/0159033 A1 6/2017 Kamtekar et al.
2017/0166928 A1 6/2017 Vyas et al.
2017/0173113 A1 6/2017 Besner et al.
2017/0175086 A1 6/2017 Schmitt et al.
2017/0175104 A1 6/2017 Doudna et al.
2017/0175142 A1 6/2017 Zhang et al.
2017/0191047 A1 7/2017 Terns et al.
2017/0191078 A1 7/2017 Zhang et al.
2017/0198269 A1 7/2017 Zhang et al.
2017/0198277 A1 7/2017 Kmiec et al.
2017/0198302 A1 7/2017 Feng et al.
2017/0211061 A1 7/2017 Weiss et al.
2017/0224843 A1 8/2017 Deglon et al.
2017/0226522 A1 8/2017 Hu et al.
2017/0233703 A1 8/2017 Xie et al.
2017/0233708 A1 8/2017 Liu et al.
2017/0233756 A1 8/2017 Begemann et al.
2017/0247671 A1 8/2017 Yung et al.
2017/0247703 A1 8/2017 Sloan et al.
2017/0268022 A1 9/2017 Liu et al.
2017/0275648 A1 9/2017 Barrangou et al.
2017/0275665 A1 9/2017 Silas et al.
2017/0283797 A1 10/2017 Robb et al.
2017/0283831 A1 10/2017 Zhang et al.
2017/0306306 A1 10/2017 Potter et al.
2017/0314016 A1 11/2017 Kim et al.
2017/0362635 A1 12/2017 Chamberlain et al.
2018/0023062 A1 1/2018 Lamb et al.
2018/0037877 A1 2/2018 Gao et al.
2018/0064077 A1 3/2018 Dunham et al.
2018/0066258 A1 3/2018 Powell
2018/0068062 A1 3/2018 Zhang et al.
2018/0073012 A1 3/2018 Liu et al.
2018/0080051 A1 3/2018 Sheikh et al.
2018/0087046 A1 3/2018 Badran et al.
2018/0100147 A1 4/2018 Yates et al.
2018/0105867 A1 4/2018 Xiao et al.
2018/0119118 A1 5/2018 Lu et al.
2018/0127759 A1 5/2018 Lu et al.
2018/0127780 A1 5/2018 Liu et al.
2018/0155708 A1 6/2018 Church et al.
2018/0155720 A1 6/2018 Donohoue et al.
2018/0163213 A1 6/2018 Aneja et al.
2018/0170984 A1 6/2018 Harris et al.
2018/0177727 A1 6/2018 Kalluri et al.
2018/0179503 A1 6/2018 Maianti et al.
2018/0179547 A1 6/2018 Zhang et al.
2018/0201921 A1 7/2018 Malcolm
2018/0230464 A1 8/2018 Zhong
2018/0230471 A1 8/2018 Storici et al.
2018/0236081 A1 8/2018 Liu et al.
2018/0237787 A1 8/2018 Maianti et al.
2018/0245066 A1 8/2018 Yao et al.
2018/0245075 A1 8/2018 Khalil et al.
2018/0258418 A1 9/2018 Kim
2018/0265864 A1 9/2018 Li et al.
2018/0273935 A1 9/2018 Lane et al.
2018/0273939 A1 9/2018 Yu et al.
2018/0273976 A1 9/2018 Ümit et al.
2018/0282722 A1 10/2018 Jakimo et al.
2018/0298391 A1 10/2018 Jakimo et al.
2018/0305688 A1 10/2018 Zhong
2018/0305704 A1 10/2018 Zhang
2018/0312822 A1 11/2018 Lee et al.
2018/0312825 A1 11/2018 Liu et al.
2018/0312828 A1 11/2018 Liu et al.
2018/0312835 A1 11/2018 Yao et al.
2018/0327756 A1 11/2018 Zhang et al.
2018/0346927 A1 12/2018 Doudna et al.
2018/0371497 A1 12/2018 Gill et al.
2019/0010481 A1 1/2019 Joung et al.
2019/0032053 A1 1/2019 Ji et al.
2019/0055543 A1 2/2019 Tran et al.
2019/0055549 A1 2/2019 Capurso et al.
2019/0062734 A1 2/2019 Cotta-Ramusino et al.
2019/0093099 A1 3/2019 Liu et al.
2019/0135869 A1 5/2019 Chatterjee et al.
2019/0167810 A1 6/2019 Hean et al.
2019/0185883 A1 6/2019 Liu et al.
2019/0203228 A1 7/2019 Bouille et al.
2019/0218547 A1 7/2019 Lee et al.
2019/0224331 A1 7/2019 Wiklander
2019/0225955 A1 7/2019 Liu et al.
2019/0233814 A1 8/2019 Zhang et al.
2019/0233847 A1 8/2019 Savage et al.
2019/0241633 A1 8/2019 Fotin-Mleczek et al.
2019/0256842 A1 8/2019 Liu et al.
2019/0264202 A1 8/2019 Church et al.
2019/0276816 A1 9/2019 Liu et al.
2019/0309290 A1 10/2019 Neuteboom et al.
2019/0322992 A1 10/2019 Liu et al.
2019/0330619 A1 10/2019 Smith et al.
2019/0352632 A1 11/2019 Liu et al.
2019/0367891 A1 12/2019 Liu et al.
2019/0388347 A1 12/2019 Wiklander et al.
2020/0010818 A1 1/2020 Liu et al.
2020/0010835 A1 1/2020 Maianti et al.
2020/0023012 A1 1/2020 Joseph et al.
2020/0056206 A1 2/2020 Tremblay et al.
2020/0060980 A1 2/2020 Von Maltzahn et al.
2020/0062813 A1 2/2020 Nordin et al.
2020/0063127 A1 2/2020 Lu et al.
2020/0071722 A1 3/2020 Liu et al.
2020/0109398 A1 4/2020 Rubens et al.
2020/0157570 A1 5/2020 Loiler
2020/0172931 A1 6/2020 Liu et al.
2020/0181619 A1 6/2020 Tang et al.
2020/0190493 A1 6/2020 Liu et al.
2020/0206360 A1 7/2020 Choi et al.
2020/0216833 A1 7/2020 Liu et al.
2020/0248156 A1 8/2020 Joung et al.
2020/0255868 A1 8/2020 Liu et al.
2020/0277587 A1 9/2020 Liu et al.
2020/0291072 A1 9/2020 Wang et al.
2020/0308571 A1 10/2020 Joung et al.
2020/0318116 A1 10/2020 Freier
2020/0323984 A1 10/2020 Liu et al.
2020/0347100 A1 11/2020 Zhang
2020/0399619 A1 12/2020 Maianti et al.
2020/0399626 A1 12/2020 Liu et al.
2020/0405639 A1 12/2020 Zhang et al.
2020/0407418 A1 12/2020 Nordin et al.
2021/0054416 A1 2/2021 Liu et al.
2021/0069254 A1 3/2021 Görgens et al.
2021/0115428 A1 4/2021 Maianti et al.
2021/0137839 A1 5/2021 Von Maltzahn et al.
2021/0187018 A1 6/2021 Von Maltzahn et al.
2021/0188903 A1 6/2021 Wiklander et al.
2021/0189432 A1 6/2021 Shepherd et al.
2021/0196809 A1 7/2021 Maianti et al.
2021/0198330 A1 7/2021 Liu et al.

(56) References Cited

U.S. PATENT DOCUMENTS

| | | | |
|---|---|---|---|
| 2021/0198698 | A1 | 7/2021 | Von Maltzahn et al. |
| 2021/0214698 | A1 | 7/2021 | Liu et al. |
| 2021/0214713 | A9 | 7/2021 | Bashor et al. |
| 2021/0228627 | A1 | 7/2021 | Von Maltzahn et al. |
| 2021/0230577 | A1 | 7/2021 | Liu et al. |
| 2021/0254127 | A1 | 8/2021 | Liu et al. |
| 2021/0261957 | A1 | 8/2021 | Petris et al. |
| 2021/0269790 | A1 | 9/2021 | Hotta et al. |
| 2021/0284697 | A1 | 9/2021 | Ohlmann et al. |
| 2021/0292753 | A1 | 9/2021 | Halperin |
| 2021/0315994 | A1 | 10/2021 | Liu et al. |
| 2021/0317440 | A1 | 10/2021 | Liu et al. |
| 2021/0347829 | A1 | 11/2021 | Malone et al. |
| 2021/0353543 | A1 | 11/2021 | Trudeau et al. |
| 2021/0380955 | A1 | 12/2021 | Bryson et al. |
| 2022/0008557 | A1 | 1/2022 | Von Maltzahn et al. |
| 2022/0033785 | A1 | 2/2022 | Liu et al. |
| 2022/0098593 | A1 | 3/2022 | Gaudelli et al. |
| 2022/0119785 | A1 | 4/2022 | Liu et al. |
| 2022/0170013 | A1 | 6/2022 | Liu et al. |
| 2022/0177877 | A1 | 6/2022 | Church et al. |
| 2022/0204975 | A1 | 6/2022 | Liu et al. |
| 2022/0213507 | A1 | 7/2022 | Liu et al. |
| 2022/0220462 | A1 | 7/2022 | Liu et al. |
| 2022/0238182 | A1 | 7/2022 | Shen et al. |
| 2022/0249697 | A1 | 8/2022 | Liu et al. |
| 2022/0282275 | A1 | 9/2022 | Liu et al. |
| 2022/0290115 | A1 | 9/2022 | Liu et al. |
| 2022/0307001 | A1 | 9/2022 | Liu et al. |
| 2022/0315906 | A1 | 10/2022 | Liu et al. |
| 2022/0356469 | A1 | 11/2022 | Liu et al. |
| 2022/0380740 | A1 | 12/2022 | Liu et al. |
| 2022/0389395 | A1 | 12/2022 | Liu et al. |
| 2023/0002745 | A1 | 1/2023 | Liu et al. |
| 2023/0021641 | A1 | 1/2023 | Liu et al. |
| 2023/0056852 | A1 | 2/2023 | Liu et al. |
| 2023/0058176 | A1 | 2/2023 | Liu et al. |
| 2023/0078265 | A1 | 3/2023 | Liu et al. |
| 2023/0086199 | A1 | 3/2023 | Liu et al. |
| 2023/0090221 | A1 | 3/2023 | Liu et al. |
| 2023/0108687 | A1 | 4/2023 | Liu et al. |
| 2023/0123669 | A1 | 4/2023 | Liu et al. |
| 2023/0127008 | A1 | 4/2023 | Liu et al. |
| 2023/0159913 | A1 | 5/2023 | Liu et al. |
| 2023/0193295 | A1 | 6/2023 | Maianti et al. |
| 2023/0220374 | A1 | 7/2023 | Liu et al. |
| 2023/0272425 | A1 | 8/2023 | Liu et al. |
| 2023/0279443 | A1 | 9/2023 | Liu et al. |
| 2023/0332144 | A1 | 10/2023 | Liu et al. |
| 2023/0340465 | A1 | 10/2023 | Liu et al. |
| 2023/0340466 | A1 | 10/2023 | Liu et al. |
| 2023/0340467 | A1 | 10/2023 | Liu et al. |
| 2023/0348883 | A1 | 11/2023 | Liu et al. |
| 2023/0357766 | A1 | 11/2023 | Liu et al. |
| 2023/0383289 | A1 | 11/2023 | Liu et al. |
| 2024/0035017 | A1 | 2/2024 | Liu et al. |
| 2024/0076652 | A1 | 3/2024 | Liu et al. |
| 2024/0110166 | A1 | 4/2024 | Maianti et al. |
| 2024/0124866 | A1 | 4/2024 | Liu et al. |
| 2024/0173430 | A1 | 5/2024 | Liu et al. |
| 2024/0209329 | A1 | 6/2024 | Liu et al. |
| 2024/0229077 | A1 | 7/2024 | Liu et al. |
| 2024/0271116 | A1 | 8/2024 | Maianti et al. |
| 2024/0287487 | A1 | 8/2024 | Liu et al. |
| 2024/0327872 | A1 | 10/2024 | Liu et al. |
| 2024/0401018 | A1 | 12/2024 | Liu et al. |
| 2024/0417715 | A1 | 12/2024 | Liu et al. |
| 2024/0417719 | A1 | 12/2024 | Liu et al. |
| 2024/0417753 | A1 | 12/2024 | Liu et al. |
| 2025/0011748 | A1 | 1/2025 | Liu et al. |
| 2025/0027114 | A1 | 1/2025 | Liu et al. |
| 2025/0034549 | A1 | 1/2025 | Liu et al. |
| 2025/0059244 | A1 | 2/2025 | Liu et al. |
| 2025/0064979 | A1 | 2/2025 | Liu et al. |
| 2025/0064981 | A1 | 2/2025 | Liu et al. |
| 2025/0084399 | A1 | 3/2025 | Liu et al. |
| 2025/0084400 | A1 | 3/2025 | Liu et al. |
| 2025/0090687 | A1 | 3/2025 | Liu et al. |
| 2025/0092374 | A1 | 3/2025 | Liu et al. |
| 2025/0092382 | A1 | 3/2025 | Liu et al. |
| 2025/0101395 | A1 | 3/2025 | Liu et al. |

FOREIGN PATENT DOCUMENTS

| | | | |
|---|---|---|---|
| AU | 2015101792 | A4 | 1/2016 |
| AU | 2012354062 | B2 | 9/2017 |
| BR | 112015013786 | A2 | 7/2017 |
| CA | 2480696 | A1 | 10/2003 |
| CA | 2894668 | A1 | 6/2014 |
| CA | 2894681 | A1 | 6/2014 |
| CA | 2894684 | A1 | 6/2014 |
| CA | 2852593 | A1 | 11/2015 |
| CA | 3193022 | A1 | 3/2022 |
| CN | 1069962 | A | 3/1993 |
| CN | 101460619 | A | 6/2009 |
| CN | 101873862 | A | 10/2010 |
| CN | 102057039 | A | 5/2011 |
| CN | 102892777 | A | 1/2013 |
| CN | 103224947 | A | 7/2013 |
| CN | 103233028 | A | 8/2013 |
| CN | 103388006 | A | 11/2013 |
| CN | 103614415 | A | 3/2014 |
| CN | 103642836 | A | 3/2014 |
| CN | 103668472 | A | 3/2014 |
| CN | 103820441 | A | 5/2014 |
| CN | 103820454 | A | 5/2014 |
| CN | 103911376 | A | 7/2014 |
| CN | 103923911 | A | 7/2014 |
| CN | 103088008 | A | 8/2014 |
| CN | 103981211 | A | 8/2014 |
| CN | 103981212 | A | 8/2014 |
| CN | 104004778 | A | 8/2014 |
| CN | 104004782 | A | 8/2014 |
| CN | 104017821 | A | 9/2014 |
| CN | 104109687 | A | 10/2014 |
| CN | 104178461 | A | 12/2014 |
| CN | 104342457 | A | 2/2015 |
| CN | 104404036 | A | 3/2015 |
| CN | 104450774 | A | 3/2015 |
| CN | 104480144 | A | 4/2015 |
| CN | 104498493 | A | 4/2015 |
| CN | 104504304 | A | 4/2015 |
| CN | 104531704 | A | 4/2015 |
| CN | 104531705 | A | 4/2015 |
| CN | 104560864 | A | 4/2015 |
| CN | 104561095 | A | 4/2015 |
| CN | 104593418 | A | 5/2015 |
| CN | 104593422 | A | 5/2015 |
| CN | 104611370 | A | 5/2015 |
| CN | 104651392 | A | 5/2015 |
| CN | 104651398 | A | 5/2015 |
| CN | 104651399 | A | 5/2015 |
| CN | 104651401 | A | 5/2015 |
| CN | 104673816 | A | 6/2015 |
| CN | 104725626 | A | 6/2015 |
| CN | 104726449 | A | 6/2015 |
| CN | 104726494 | A | 6/2015 |
| CN | 104745626 | A | 7/2015 |
| CN | 104762321 | A | 7/2015 |
| CN | 104805078 | A | 7/2015 |
| CN | 104805099 | A | 7/2015 |
| CN | 104805118 | A | 7/2015 |
| CN | 104846010 | A | 8/2015 |
| CN | 104894068 | A | 9/2015 |
| CN | 104894075 | A | 9/2015 |
| CN | 104928321 | A | 9/2015 |
| CN | 105039339 | A | 11/2015 |
| CN | 105039399 | A | 11/2015 |
| CN | 105063061 | A | 11/2015 |
| CN | 105087620 | A | 11/2015 |
| CN | 105112422 | A | 12/2015 |
| CN | 105112445 | A | 12/2015 |
| CN | 105112519 | A | 12/2015 |
| CN | 105121648 | A | 12/2015 |

(56) References Cited

FOREIGN PATENT DOCUMENTS

CN 105132427 A 12/2015
CN 105132451 A 12/2015
CN 105177038 A 12/2015
CN 105177126 A 12/2015
CN 105210981 A 1/2016
CN 105219799 A 1/2016
CN 105238806 A 1/2016
CN 105255937 A 1/2016
CN 105274144 A 1/2016
CN 105296518 A 2/2016
CN 105296537 A 2/2016
CN 105316324 A 2/2016
CN 105316327 A 2/2016
CN 105316337 A 2/2016
CN 105331607 A 2/2016
CN 105331608 A 2/2016
CN 105331609 A 2/2016
CN 105331627 A 2/2016
CN 105400773 A 3/2016
CN 105400779 A 3/2016
CN 105400810 A 3/2016
CN 105441451 A 3/2016
CN 105462968 A 4/2016
CN 105463003 A 4/2016
CN 105463027 A 4/2016
CN 105492608 A 4/2016
CN 105492609 A 4/2016
CN 105505976 A 4/2016
CN 105505979 A 4/2016
CN 105518134 A 4/2016
CN 105518135 A 4/2016
CN 105518137 A 4/2016
CN 105518138 A 4/2016
CN 105518139 A 4/2016
CN 105518140 A 4/2016
CN 105543228 A 5/2016
CN 105543266 A 5/2016
CN 105543270 A 5/2016
CN 105567688 A 5/2016
CN 105567689 A 5/2016
CN 105567734 A 5/2016
CN 105567735 A 5/2016
CN 105567738 A 5/2016
CN 105593367 A 5/2016
CN 105594664 A 5/2016
CN 105602987 A 5/2016
CN 105624146 A 6/2016
CN 105624187 A 6/2016
CN 105646719 A 6/2016
CN 105647922 A 6/2016
CN 105647962 A 6/2016
CN 105647968 A 6/2016
CN 105647969 A 6/2016
CN 105671070 A 6/2016
CN 105671083 A 6/2016
CN 105695485 A 6/2016
CN 105779448 A 7/2016
CN 105779449 A 7/2016
CN 105802980 A 7/2016
CN 105821039 A 8/2016
CN 105821040 A 8/2016
CN 105821049 A 8/2016
CN 105821072 A 8/2016
CN 105821075 A 8/2016
CN 105821116 A 8/2016
CN 105838733 A 8/2016
CN 105861547 A 8/2016
CN 105861552 A 8/2016
CN 105861554 A 8/2016
CN 105886498 A 8/2016
CN 105886534 A 8/2016
CN 105886616 A 8/2016
CN 105907758 A 8/2016
CN 105907785 A 8/2016
CN 105925608 A 9/2016
CN 105934516 A 9/2016
CN 105950560 A 9/2016
CN 105950626 A 9/2016
CN 105950633 A 9/2016
CN 105950639 A 9/2016
CN 105985985 A 10/2016
CN 106011104 A 10/2016
CN 106011150 A 10/2016
CN 106011167 A 10/2016
CN 106011171 A 10/2016
CN 106032540 A 10/2016
CN 106047803 A 10/2016
CN 106047877 A 10/2016
CN 106047930 A 10/2016
CN 106086008 A 11/2016
CN 106086028 A 11/2016
CN 106086061 A 11/2016
CN 106086062 A 11/2016
CN 106103475 A 11/2016
CN 106109417 A 11/2016
CN 106119275 A 11/2016
CN 106119283 A 11/2016
CN 106148286 A 11/2016
CN 106148370 A 11/2016
CN 106148416 A 11/2016
CN 106167525 A 11/2016
CN 106167808 A 11/2016
CN 106167810 A 11/2016
CN 106167821 A 11/2016
CN 106172238 A 12/2016
CN 106190903 A 12/2016
CN 106191057 A 12/2016
CN 106191061 A 12/2016
CN 106191062 A 12/2016
CN 106191064 A 12/2016
CN 106191071 A 12/2016
CN 106191099 A 12/2016
CN 106191107 A 12/2016
CN 106191113 A 12/2016
CN 106191114 A 12/2016
CN 106191116 A 12/2016
CN 106191124 A 12/2016
CN 106222177 A 12/2016
CN 106222193 A 12/2016
CN 106222203 A 12/2016
CN 106232823 A 12/2016
CN 106244555 A 12/2016
CN 106244557 A 12/2016
CN 106244591 A 12/2016
CN 106244609 A 12/2016
CN 106282241 A 1/2017
CN 106318934 A 1/2017
CN 106318973 A 1/2017
CN 106350540 A 1/2017
CN 106367435 A 2/2017
CN 106399306 A 2/2017
CN 106399311 A 2/2017
CN 106399360 A 2/2017
CN 106399367 A 2/2017
CN 106399375 A 2/2017
CN 106399377 A 2/2017
CN 106434651 A 2/2017
CN 106434663 A 2/2017
CN 106434688 A 2/2017
CN 106434737 A 2/2017
CN 106434748 A 2/2017
CN 106434752 A 2/2017
CN 106434782 A 2/2017
CN 106446600 A 2/2017
CN 106479985 A 3/2017
CN 106480027 A 3/2017
CN 106480036 A 3/2017
CN 106480067 A 3/2017
CN 106480080 A 3/2017
CN 106480083 A 3/2017
CN 106480097 A 3/2017
CN 106544351 A 3/2017
CN 106544353 A 3/2017
CN 106544357 A 3/2017

(56) References Cited

FOREIGN PATENT DOCUMENTS

| | | | |
|---|---|---|---|
| CN | 106554969 | A | 4/2017 |
| CN | 106566838 | A | 4/2017 |
| CN | 106701763 | A | 5/2017 |
| CN | 106701808 | A | 5/2017 |
| CN | 106701818 | A | 5/2017 |
| CN | 106701823 | A | 5/2017 |
| CN | 106701830 | A | 5/2017 |
| CN | 106754912 | A | 5/2017 |
| CN | 106755026 | A | 5/2017 |
| CN | 106755077 | A | 5/2017 |
| CN | 106755088 | A | 5/2017 |
| CN | 106755091 | A | 5/2017 |
| CN | 106755097 | A | 5/2017 |
| CN | 106755424 | A | 5/2017 |
| CN | 106801056 | A | 6/2017 |
| CN | 106834323 | A | 6/2017 |
| CN | 106834341 | A | 6/2017 |
| CN | 106834347 | A | 6/2017 |
| CN | 106845151 | A | 6/2017 |
| CN | 106868008 | A | 6/2017 |
| CN | 106868031 | A | 6/2017 |
| CN | 106906240 | A | 6/2017 |
| CN | 106906242 | A | 6/2017 |
| CN | 106916820 | A | 7/2017 |
| CN | 106916852 | A | 7/2017 |
| CN | 106939303 | A | 7/2017 |
| CN | 106947750 | A | 7/2017 |
| CN | 106947780 | A | 7/2017 |
| CN | 106957830 | A | 7/2017 |
| CN | 106957831 | A | 7/2017 |
| CN | 106957844 | A | 7/2017 |
| CN | 106957855 | A | 7/2017 |
| CN | 106957858 | A | 7/2017 |
| CN | 106967697 | A | 7/2017 |
| CN | 106967726 | A | 7/2017 |
| CN | 106978428 | A | 7/2017 |
| CN | 106987570 | A | 7/2017 |
| CN | 106987757 | A | 7/2017 |
| CN | 107012164 | A | 8/2017 |
| CN | 107012174 | A | 8/2017 |
| CN | 107012213 | A | 8/2017 |
| CN | 107012250 | A | 8/2017 |
| CN | 107022562 | A | 8/2017 |
| CN | 107034188 | A | 8/2017 |
| CN | 107034218 | A | 8/2017 |
| CN | 107034229 | A | 8/2017 |
| CN | 107043775 | A | 8/2017 |
| CN | 107043779 | A | 8/2017 |
| CN | 107043787 | A | 8/2017 |
| CN | 107058320 | A | 8/2017 |
| CN | 107058328 | A | 8/2017 |
| CN | 107058358 | A | 8/2017 |
| CN | 107058372 | A | 8/2017 |
| CN | 107083392 | A | 8/2017 |
| CN | 107099533 | A | 8/2017 |
| CN | 107099850 | A | 8/2017 |
| CN | 107119053 | A | 9/2017 |
| CN | 107119071 | A | 9/2017 |
| CN | 107129999 | A | 9/2017 |
| CN | 107130000 | A | 9/2017 |
| CN | 107142272 | A | 9/2017 |
| CN | 107142282 | A | 9/2017 |
| CN | 107177591 | A | 9/2017 |
| CN | 107177595 | A | 9/2017 |
| CN | 107177625 | A | 9/2017 |
| CN | 107177631 | A | 9/2017 |
| CN | 107190006 | A | 9/2017 |
| CN | 107190008 | A | 9/2017 |
| CN | 107217042 | A | 9/2017 |
| CN | 107217075 | A | 9/2017 |
| CN | 107227307 | A | 10/2017 |
| CN | 107227352 | A | 10/2017 |
| CN | 107236737 | A | 10/2017 |
| CN | 107236739 | A | 10/2017 |
| CN | 107236741 | A | 10/2017 |
| CN | 107245502 | A | 10/2017 |
| CN | 107254485 | A | 10/2017 |
| CN | 107266541 | A | 10/2017 |
| CN | 107267515 | A | 10/2017 |
| CN | 107287245 | A | 10/2017 |
| CN | 107298701 | A | 10/2017 |
| CN | 107299114 | A | 10/2017 |
| CN | 107304435 | A | 10/2017 |
| CN | 107312785 | A | 11/2017 |
| CN | 107312793 | A | 11/2017 |
| CN | 107312795 | A | 11/2017 |
| CN | 107312798 | A | 11/2017 |
| CN | 107326042 | A | 11/2017 |
| CN | 107326046 | A | 11/2017 |
| CN | 107354156 | A | 11/2017 |
| CN | 107354173 | A | 11/2017 |
| CN | 107356793 | A | 11/2017 |
| CN | 107362372 | A | 11/2017 |
| CN | 107365786 | A | 11/2017 |
| CN | 107365804 | A | 11/2017 |
| CN | 107384894 | A | 11/2017 |
| CN | 107384922 | A | 11/2017 |
| CN | 107384926 | A | 11/2017 |
| CN | 107400677 | A | 11/2017 |
| CN | 107418974 | A | 12/2017 |
| CN | 107435051 | A | 12/2017 |
| CN | 107435069 | A | 12/2017 |
| CN | 107446922 | A | 12/2017 |
| CN | 107446923 | A | 12/2017 |
| CN | 107446924 | A | 12/2017 |
| CN | 107446932 | A | 12/2017 |
| CN | 107446951 | A | 12/2017 |
| CN | 107446954 | A | 12/2017 |
| CN | 107460196 | A | 12/2017 |
| CN | 107474129 | A | 12/2017 |
| CN | 107475300 | A | 12/2017 |
| CN | 107488649 | A | 12/2017 |
| CN | 107502608 | A | 12/2017 |
| CN | 107502618 | A | 12/2017 |
| CN | 107513531 | A | 12/2017 |
| CN | 107519492 | A | 12/2017 |
| CN | 107523567 | A | 12/2017 |
| CN | 107523583 | A | 12/2017 |
| CN | 107541525 | A | 1/2018 |
| CN | 107557373 | A | 1/2018 |
| CN | 107557378 | A | 1/2018 |
| CN | 107557381 | A | 1/2018 |
| CN | 107557390 | A | 1/2018 |
| CN | 107557393 | A | 1/2018 |
| CN | 107557394 | A | 1/2018 |
| CN | 107557455 | A | 1/2018 |
| CN | 107574179 | A | 1/2018 |
| CN | 107586777 | A | 1/2018 |
| CN | 107586779 | A | 1/2018 |
| CN | 107604003 | A | 1/2018 |
| CN | 107619829 | A | 1/2018 |
| CN | 107619837 | A | 1/2018 |
| CN | 107630006 | A | 1/2018 |
| CN | 107630041 | A | 1/2018 |
| CN | 107630042 | A | 1/2018 |
| CN | 107630043 | A | 1/2018 |
| CN | 107641631 | A | 1/2018 |
| CN | 107653256 | A | 2/2018 |
| CN | 107686848 | A | 2/2018 |
| CN | 206970581 | A | 2/2018 |
| CN | 107760652 | A | 3/2018 |
| CN | 107760663 | A | 3/2018 |
| CN | 107760684 | A | 3/2018 |
| CN | 107760715 | A | 3/2018 |
| CN | 107784200 | A | 3/2018 |
| CN | 107794272 | A | 3/2018 |
| CN | 107794276 | A | 3/2018 |
| CN | 107815463 | A | 3/2018 |
| CN | 107828738 | A | 3/2018 |
| CN | 107828794 | A | 3/2018 |
| CN | 107828826 | A | 3/2018 |
| CN | 107828874 | A | 3/2018 |
| CN | 107858346 | A | 3/2018 |
| CN | 107858373 | A | 3/2018 |

(56) References Cited

FOREIGN PATENT DOCUMENTS

| | | | | | |
|---|---|---|---|---|---|
| CN | 107880132 | A | | 4/2018 | |
| CN | 107881184 | A | | 4/2018 | |
| CN | 107893074 | A | | 4/2018 | |
| CN | 107893075 | A | | 4/2018 | |
| CN | 107893076 | A | | 4/2018 | |
| CN | 107893080 | A | | 4/2018 | |
| CN | 107893086 | A | | 4/2018 | |
| CN | 107904261 | A | | 4/2018 | |
| CN | 107937427 | A | | 4/2018 | |
| CN | 107937432 | A | | 4/2018 | |
| CN | 107937501 | A | | 4/2018 | |
| CN | 107974466 | A | | 5/2018 | |
| CN | 107988229 | A | | 5/2018 | |
| CN | 107988246 | A | | 5/2018 | |
| CN | 107988256 | A | | 5/2018 | |
| CN | 107988268 | A | | 5/2018 | |
| CN | 108018316 | A | | 5/2018 | |
| CN | 108034656 | A | | 5/2018 | |
| CN | 108048466 | A | | 5/2018 | |
| CN | 108102940 | A | | 6/2018 | |
| CN | 108103090 | A | | 6/2018 | |
| CN | 108103092 | A | | 6/2018 | |
| CN | 108103098 | A | | 6/2018 | |
| CN | 108103586 | A | | 6/2018 | |
| CN | 108148835 | A | | 6/2018 | |
| CN | 108148837 | A | | 6/2018 | |
| CN | 108148873 | A | | 6/2018 | |
| CN | 108192956 | A | | 6/2018 | |
| CN | 108243575 | A | | 7/2018 | |
| CN | 108251423 | A | | 7/2018 | |
| CN | 108251451 | A | | 7/2018 | |
| CN | 108251452 | A | | 7/2018 | |
| CN | 108342480 | A | | 7/2018 | |
| CN | 108359691 | A | | 8/2018 | |
| CN | 108359712 | A | | 8/2018 | |
| CN | 108384784 | A | | 8/2018 | |
| CN | 108396027 | A | | 8/2018 | |
| CN | 108410877 | A | | 8/2018 | |
| CN | 108410906 | A | | 8/2018 | |
| CN | 108410907 | A | | 8/2018 | |
| CN | 108410911 | A | | 8/2018 | |
| CN | 108424931 | A | | 8/2018 | |
| CN | 108441519 | A | | 8/2018 | |
| CN | 108441520 | A | | 8/2018 | |
| CN | 108472314 | A | | 8/2018 | |
| CN | 108486108 | A | | 9/2018 | |
| CN | 108486111 | A | | 9/2018 | |
| CN | 108486145 | A | | 9/2018 | |
| CN | 108486146 | A | | 9/2018 | |
| CN | 108486154 | A | | 9/2018 | |
| CN | 108486159 | A | | 9/2018 | |
| CN | 108486234 | A | | 9/2018 | |
| CN | 108504657 | A | | 9/2018 | |
| CN | 108504685 | A | | 9/2018 | |
| CN | 108504693 | A | | 9/2018 | |
| CN | 108513575 | A | | 9/2018 | |
| CN | 108546712 | A | | 9/2018 | |
| CN | 108546717 | A | | 9/2018 | |
| CN | 108546718 | A | | 9/2018 | |
| CN | 108559730 | A | | 9/2018 | |
| CN | 108559732 | A | | 9/2018 | |
| CN | 108559745 | A | | 9/2018 | |
| CN | 108559760 | A | | 9/2018 | |
| CN | 108570479 | A | | 9/2018 | |
| CN | 108588071 | A | | 9/2018 | |
| CN | 108588123 | A | | 9/2018 | |
| CN | 108588128 | A | | 9/2018 | |
| CN | 108588182 | A | | 9/2018 | |
| CN | 108610399 | A | | 10/2018 | |
| CN | 108611364 | A | | 10/2018 | |
| CN | 108624622 | A | | 10/2018 | |
| CN | 108642053 | A | | 10/2018 | |
| CN | 108642055 | A | | 10/2018 | |
| CN | 108642077 | A | | 10/2018 | |
| CN | 108642078 | A | | 10/2018 | |
| CN | 108642090 | A | | 10/2018 | |
| CN | 108690844 | A | | 10/2018 | |
| CN | 108699542 | A | | 10/2018 | |
| CN | 108707604 | A | | 10/2018 | |
| CN | 108707620 | A | | 10/2018 | |
| CN | 108707621 | A | | 10/2018 | |
| CN | 108707628 | A | | 10/2018 | |
| CN | 108707629 | A | | 10/2018 | |
| CN | 108715850 | A | | 10/2018 | |
| CN | 108728476 | A | | 11/2018 | |
| CN | 108728486 | A | | 11/2018 | |
| CN | 108753772 | A | | 11/2018 | |
| CN | 108753783 | A | | 11/2018 | |
| CN | 108753813 | A | | 11/2018 | |
| CN | 108753817 | A | | 11/2018 | |
| CN | 108753832 | A | | 11/2018 | |
| CN | 108753835 | A | | 11/2018 | |
| CN | 108753836 | A | | 11/2018 | |
| CN | 108795902 | A | | 11/2018 | |
| CN | 108822217 | A | | 11/2018 | |
| CN | 108823248 | A | | 11/2018 | |
| CN | 108823249 | A | | 11/2018 | |
| CN | 108823291 | A | | 11/2018 | |
| CN | 108841845 | A | | 11/2018 | |
| CN | 108853133 | A | | 11/2018 | |
| CN | 108866093 | A | | 11/2018 | |
| CN | 108893529 | A | | 11/2018 | |
| CN | 108913664 | A | | 11/2018 | |
| CN | 108913691 | A | | 11/2018 | |
| CN | 108913714 | A | | 11/2018 | |
| CN | 108913717 | A | | 11/2018 | |
| CN | 109517841 | A | * | 3/2019 | ........... C12N 15/102 |
| EP | 0264166 | A1 | | 4/1988 | |
| EP | 0321201 | B2 | | 6/1989 | |
| EP | 0519463 | A1 | | 12/1992 | |
| EP | 1085892 | A2 | | 3/2001 | |
| EP | 1092770 | A2 | | 4/2001 | |
| EP | 2350295 | B1 | | 5/2013 | |
| EP | 2604255 | A1 | | 6/2013 | |
| EP | 2840140 | A1 | | 2/2015 | |
| EP | 2877490 | A2 | | 6/2015 | |
| EP | 2966170 | A1 | | 1/2016 | |
| EP | 3009511 | A2 | | 4/2016 | |
| EP | 3031921 | A1 | | 6/2016 | |
| EP | 3045537 | A1 | | 7/2016 | |
| EP | 3115457 | A1 | | 1/2017 | |
| EP | 3144390 | A1 | | 3/2017 | |
| EP | 2583974 | B1 | | 4/2017 | |
| EP | 3199632 | A1 | | 8/2017 | |
| EP | 3216867 | A1 | | 9/2017 | |
| EP | 3235828 | A1 | | 10/2017 | |
| EP | 3252160 | A1 | | 12/2017 | |
| EP | 2498823 | B1 | | 8/2018 | |
| EP | 3365437 | A1 | | 8/2018 | |
| EP | 3454889 | A2 | | 3/2019 | |
| EP | 3008192 | B1 | | 7/2019 | |
| EP | 3079725 | B1 | | 10/2019 | |
| EP | 3450553 | B1 | | 12/2019 | |
| EP | 3622079 | A1 | | 3/2020 | |
| EP | 3389700 | B1 | | 11/2020 | |
| EP | 3294756 | B1 | | 12/2020 | |
| EP | 3752623 | A1 | | 12/2020 | |
| EP | 2776567 | B1 | | 1/2021 | |
| EP | 3177726 | B1 | | 1/2021 | |
| EP | 3788155 | A1 | | 3/2021 | |
| EP | 3793570 | A2 | | 3/2021 | |
| EP | 3455239 | B1 | | 4/2021 | |
| EP | 3820995 | A1 | | 5/2021 | |
| EP | 3844272 | A1 | | 7/2021 | |
| EP | 3856898 | A1 | | 8/2021 | |
| EP | 3880717 | A1 | | 9/2021 | |
| EP | 3880831 | A1 | | 9/2021 | |
| EP | 4031561 | A1 | | 7/2022 | |
| ES | 2740248 | T3 | | 2/2020 | |
| GB | 2528177 | A | | 1/2016 | |
| GB | 2531454 | A1 | | 4/2016 | |
| GB | 2542653 | A | | 3/2017 | |
| HK | 1208045 | A1 | | 2/2016 | |
| JP | 2007-501626 | A | | 2/2007 | |

(56) References Cited

FOREIGN PATENT DOCUMENTS

| | | | |
|---|---|---|---|
| JP | 2008-515405 | A | 5/2008 |
| JP | 2010-033344 | A | 2/2010 |
| JP | 2010-535744 | A | 11/2010 |
| JP | 2010-539929 | A | 12/2010 |
| JP | 2011-081011 | A | 4/2011 |
| JP | 2011-523353 | A | 8/2011 |
| JP | 2012-525146 | A | 10/2012 |
| JP | 2012-210172 | A | 11/2012 |
| JP | 2012-531909 | A | 12/2012 |
| JP | 2015-523856 | A | 8/2015 |
| JP | 2015-532654 | A | 11/2015 |
| JP | 2016-525888 | A | 9/2016 |
| JP | 2016-534132 | A | 11/2016 |
| JP | 2017-500035 | A | 1/2017 |
| JP | 2018-521045 | A | 8/2018 |
| JP | 2019-506123 | A | 2/2019 |
| JP | 6629734 | B2 | 1/2020 |
| JP | 6633524 | B2 | 1/2020 |
| JP | 6830517 | B2 | 2/2021 |
| JP | 7324523 | B2 | 8/2023 |
| KR | 101584933 | B1 | 1/2016 |
| KR | 2016-0050069 | A | 5/2016 |
| KR | 20160133380 | A | 11/2016 |
| KR | 20170037025 | A | 4/2017 |
| KR | 20170037028 | A | 4/2017 |
| KR | 101748575 | B1 | 6/2017 |
| KR | 20170128137 | A | 11/2017 |
| KR | 2018-0022465 | A | 3/2018 |
| RU | 2016104674 | A | 8/2017 |
| RU | 2634395 | C1 | 10/2017 |
| RU | 2652899 | C1 | 5/2018 |
| RU | 2015128057 | A | 3/2019 |
| RU | 2015128098 | A | 3/2019 |
| RU | 2687451 | C1 | 5/2019 |
| RU | 2019112514 | A | 6/2019 |
| RU | 2019127300 | A | 9/2019 |
| RU | 2701850 | C2 | 10/2019 |
| SG | 10201707569 | Y | 10/2017 |
| SG | 10201710486 | | 1/2018 |
| SG | 10201710487 | | 1/2018 |
| SG | 10201710488 | T | 1/2018 |
| TW | I608100 | B | 12/2017 |
| TW | 201809272 | A | 3/2018 |
| TW | 2018-29773 | A | 8/2018 |
| WO | WO 1990/002809 | A1 | 3/1990 |
| WO | WO 1991/003162 | A1 | 3/1991 |
| WO | WO 1991/016024 | A1 | 10/1991 |
| WO | WO 1991/017271 | A1 | 11/1991 |
| WO | WO 1991/017424 | A1 | 11/1991 |
| WO | WO 1992/006188 | A2 | 4/1992 |
| WO | WO 1992/006200 | A1 | 4/1992 |
| WO | WO 1992/007065 | A1 | 4/1992 |
| WO | WO 1993/015187 | A1 | 8/1993 |
| WO | WO 1993/024641 | A2 | 12/1993 |
| WO | WO 1994/018316 | A2 | 8/1994 |
| WO | WO 1994/026877 | A1 | 11/1994 |
| WO | WO 1996/004403 | A1 | 2/1996 |
| WO | WO 1996/010640 | A1 | 4/1996 |
| WO | WO 1997/025416 | A2 | 7/1997 |
| WO | WO 1998/032845 | A1 | 7/1998 |
| WO | WO 1998/050538 | A1 | 11/1998 |
| WO | WO 2001/036452 | A2 | 5/2001 |
| WO | WO 2001/038547 | A2 | 5/2001 |
| WO | WO 2001/083692 | A2 | 11/2001 |
| WO | WO 2002/059296 | A2 | 8/2002 |
| WO | WO 2002/068676 | A2 | 9/2002 |
| WO | WO 2002/103028 | A2 | 12/2002 |
| WO | WO 2003/004608 | A2 | 1/2003 |
| WO | WO 2004/007684 | A2 | 1/2004 |
| WO | WO 2005/014791 | A2 | 2/2005 |
| WO | WO 2005/019415 | A2 | 3/2005 |
| WO | WO 2006/002547 | A1 | 1/2006 |
| WO | WO 2006/042112 | A2 | 4/2006 |
| WO | WO 2007/025097 | A2 | 3/2007 |
| WO | WO 2007/037444 | A1 | 4/2007 |

| | | | |
|---|---|---|---|
| WO | WO 2007/066923 | A1 | 6/2007 |
| WO | WO 2007/136815 | A2 | 11/2007 |
| WO | WO 2007/143574 | A1 | 12/2007 |
| WO | WO 2008/005529 | A2 | 1/2008 |
| WO | WO 2008/108989 | A2 | 9/2008 |
| WO | WO 2009/002418 | A2 | 12/2008 |
| WO | WO 2009/019317 | A1 | 2/2009 |
| WO | WO 2009/098290 | A1 | 8/2009 |
| WO | WO 2009/134808 | A2 | 11/2009 |
| WO | WO 2010/011961 | A2 | 1/2010 |
| WO | WO 2010/012902 | A1 | 2/2010 |
| WO | WO 2010/028347 | A2 | 3/2010 |
| WO | WO 2010/054108 | A2 | 5/2010 |
| WO | WO 2010/054154 | A2 | 5/2010 |
| WO | WO 2010/068289 | A2 | 6/2010 |
| WO | WO 2010/075424 | A2 | 7/2010 |
| WO | WO 2010/091122 | A1 | 8/2010 |
| WO | WO 2010/102257 | A2 | 9/2010 |
| WO | WO 2010/104749 | A2 | 9/2010 |
| WO | WO 2010/129019 | A2 | 11/2010 |
| WO | WO 2010/129023 | A2 | 11/2010 |
| WO | WO 2010/132092 | A2 | 11/2010 |
| WO | WO 2010/144150 | A2 | 12/2010 |
| WO | WO 2011/002503 | A1 | 1/2011 |
| WO | WO 2011/017293 | A2 | 2/2011 |
| WO | WO 2011/053868 | A1 | 5/2011 |
| WO | WO 2011/053982 | A2 | 5/2011 |
| WO | WO 2011/068810 | A1 | 6/2011 |
| WO | WO 2011/075627 | A1 | 6/2011 |
| WO | WO 2011/091311 | A2 | 7/2011 |
| WO | WO 2011/091396 | A1 | 7/2011 |
| WO | WO 2011/109031 | A1 | 9/2011 |
| WO | WO 2011/143124 | A2 | 11/2011 |
| WO | WO 2011/147590 | A2 | 12/2011 |
| WO | WO 2011/159369 | A1 | 12/2011 |
| WO | WO 2012/054726 | A1 | 4/2012 |
| WO | WO 2012/061815 | A2 | 5/2012 |
| WO | WO 2012/065043 | A2 | 5/2012 |
| WO | WO 2012/088381 | A2 | 6/2012 |
| WO | WO 2012/125445 | A2 | 9/2012 |
| WO | WO 2012/138927 | A2 | 10/2012 |
| WO | WO 2012/149470 | A1 | 11/2012 |
| WO | WO 2012/158985 | A2 | 11/2012 |
| WO | WO 2012/158986 | A2 | 11/2012 |
| WO | WO 2012/164565 | A1 | 12/2012 |
| WO | WO 2012/170930 | A1 | 12/2012 |
| WO | WO 2013/012674 | A1 | 1/2013 |
| WO | WO 2013/013105 | A1 | 1/2013 |
| WO | WO 2013/039857 | A1 | 3/2013 |
| WO | WO 2013/039861 | A2 | 3/2013 |
| WO | WO 2013/040093 | A2 | 3/2013 |
| WO | WO 2013/045632 | A1 | 4/2013 |
| WO | WO 2013/047844 | A1 | 4/2013 |
| WO | WO 2013/066438 | A2 | 5/2013 |
| WO | WO 2013/086441 | A2 | 6/2013 |
| WO | WO 2013/086444 | A2 | 6/2013 |
| WO | WO 2013/098244 | A1 | 7/2013 |
| WO | WO 2013/119602 | A1 | 8/2013 |
| WO | WO 2013/120022 | A2 | 8/2013 |
| WO | WO 2013/122617 | A1 | 8/2013 |
| WO | WO 2013/126794 | A1 | 8/2013 |
| WO | WO 2013/130683 | A2 | 9/2013 |
| WO | WO 2013/130824 | A1 | 9/2013 |
| WO | WO 2013/141680 | A1 | 9/2013 |
| WO | WO 2013/142578 | A2 | 9/2013 |
| WO | WO 2013/152359 | A1 | 10/2013 |
| WO | WO 2013/160230 | A1 | 10/2013 |
| WO | WO 2013/166315 | A1 | 11/2013 |
| WO | WO 2013/169398 | A2 | 11/2013 |
| WO | WO 2013/169802 | A1 | 11/2013 |
| WO | WO 2013/176915 | A1 | 11/2013 |
| WO | WO 2013/176916 | A1 | 11/2013 |
| WO | WO 2013/181440 | A1 | 12/2013 |
| WO | WO 2013/186754 | A2 | 12/2013 |
| WO | WO 2013/188037 | A2 | 12/2013 |
| WO | WO 2013/188522 | A2 | 12/2013 |
| WO | WO 2013/188638 | A2 | 12/2013 |
| WO | WO 2013/192278 | A1 | 12/2013 |
| WO | WO 2013/142378 | A9 | 1/2014 |

(56) References Cited

FOREIGN PATENT DOCUMENTS

| | | | |
|---|---|---|---|
| WO | WO 2014/004336 | A2 | 1/2014 |
| WO | WO 2014/005042 | A2 | 1/2014 |
| WO | WO 2014/011237 | A1 | 1/2014 |
| WO | WO 2014/011901 | A2 | 1/2014 |
| WO | WO 2014/018423 | A2 | 1/2014 |
| WO | WO 2014/020608 | A1 | 2/2014 |
| WO | WO 2014/022120 | A1 | 2/2014 |
| WO | WO 2014/022702 | A2 | 2/2014 |
| WO | WO 2014/036219 | A2 | 3/2014 |
| WO | WO 2014/039513 | A2 | 3/2014 |
| WO | WO 2014/039523 | A1 | 3/2014 |
| WO | WO 2014/039585 | A2 | 3/2014 |
| WO | WO 2014/039684 | A1 | 3/2014 |
| WO | WO 2014/039692 | A2 | 3/2014 |
| WO | WO 2014/039702 | A2 | 3/2014 |
| WO | WO 2014/039872 | A1 | 3/2014 |
| WO | WO 2014/039970 | A1 | 3/2014 |
| WO | WO 2014/041327 | A1 | 3/2014 |
| WO | WO 2014/043143 | A1 | 3/2014 |
| WO | WO 2014/047103 | A2 | 3/2014 |
| WO | WO 2014/055782 | A1 | 4/2014 |
| WO | WO 2014/059173 | A2 | 4/2014 |
| WO | WO 2014/059255 | A1 | 4/2014 |
| WO | WO 2014/065596 | A1 | 5/2014 |
| WO | WO 2014/066505 | A1 | 5/2014 |
| WO | WO 2014/068346 | A2 | 5/2014 |
| WO | WO 2014/070887 | A1 | 5/2014 |
| WO | WO 2014/071006 | A1 | 5/2014 |
| WO | WO 2014/071219 | A1 | 5/2014 |
| WO | WO 2014/071235 | A1 | 5/2014 |
| WO | WO 2014/072941 | A1 | 5/2014 |
| WO | WO 2014/081729 | A1 | 5/2014 |
| WO | WO 2014/081730 | A1 | 5/2014 |
| WO | WO 2014/081855 | A1 | 5/2014 |
| WO | WO 2014/082644 | A1 | 6/2014 |
| WO | WO 2014/085261 | A1 | 6/2014 |
| WO | WO 2014/085593 | A1 | 6/2014 |
| WO | WO 2014/085830 | A2 | 6/2014 |
| WO | WO 2014/089212 | A1 | 6/2014 |
| WO | WO 2014/089290 | A1 | 6/2014 |
| WO | WO 2014/089348 | A1 | 6/2014 |
| WO | WO 2014/089513 | A1 | 6/2014 |
| WO | WO 2014/089533 | A2 | 6/2014 |
| WO | WO 2014/089541 | A2 | 6/2014 |
| WO | WO 2014/093479 | A1 | 6/2014 |
| WO | WO 2014/093595 | A1 | 6/2014 |
| WO | WO 2014/093622 | A2 | 6/2014 |
| WO | WO 2014/093635 | A1 | 6/2014 |
| WO | WO 2014/093655 | A2 | 6/2014 |
| WO | WO 2014/093661 | A2 | 6/2014 |
| WO | WO 2014/093694 | A1 | 6/2014 |
| WO | WO 2014/093701 | A1 | 6/2014 |
| WO | WO 2014/093709 | A1 | 6/2014 |
| WO | WO 2014/093712 | A1 | 6/2014 |
| WO | WO 2014/093718 | A1 | 6/2014 |
| WO | WO 2014/093736 | A1 | 6/2014 |
| WO | WO 2014/093768 | A1 | 6/2014 |
| WO | WO 2014/093852 | A1 | 6/2014 |
| WO | WO 2014/096972 | A2 | 6/2014 |
| WO | WO 2014/099744 | A1 | 6/2014 |
| WO | WO 2014/099750 | A2 | 6/2014 |
| WO | WO 2014/104878 | A1 | 7/2014 |
| WO | WO 2014/110006 | A1 | 7/2014 |
| WO | WO 2014/110552 | A1 | 7/2014 |
| WO | WO 2014/113493 | A1 | 7/2014 |
| WO | WO 2014/123967 | A2 | 8/2014 |
| WO | WO 2014/124226 | A1 | 8/2014 |
| WO | WO 2014/125668 | A1 | 8/2014 |
| WO | WO 2014/127287 | A1 | 8/2014 |
| WO | WO 2014/128324 | A1 | 8/2014 |
| WO | WO 2014/128659 | A1 | 8/2014 |
| WO | WO 2014/130706 | A1 | 8/2014 |
| WO | WO 2014/130955 | A1 | 8/2014 |
| WO | WO 2014/131833 | A1 | 9/2014 |
| WO | WO 2014/138379 | A1 | 9/2014 |
| WO | WO 2014/143381 | A1 | 9/2014 |
| WO | WO 2014/144094 | A1 | 9/2014 |
| WO | WO 2014/144155 | A1 | 9/2014 |
| WO | WO 2014/144288 | A1 | 9/2014 |
| WO | WO 2014/144592 | A2 | 9/2014 |
| WO | WO 2014/144761 | A2 | 9/2014 |
| WO | WO 2014/144951 | A1 | 9/2014 |
| WO | WO 2014/145599 | A2 | 9/2014 |
| WO | WO 2014/145936 | A2 | 9/2014 |
| WO | WO 2014/150624 | A1 | 9/2014 |
| WO | WO 2014/152432 | A2 | 9/2014 |
| WO | WO 2014/152940 | A1 | 9/2014 |
| WO | WO 2014/153118 | A1 | 9/2014 |
| WO | WO 2014/153470 | A2 | 9/2014 |
| WO | WO 2014/158593 | A1 | 10/2014 |
| WO | WO 2014/161821 | A1 | 10/2014 |
| WO | WO 2014/164466 | A1 | 10/2014 |
| WO | WO 2014/165177 | A1 | 10/2014 |
| WO | WO 2014/165349 | A1 | 10/2014 |
| WO | WO 2014/165612 | A2 | 10/2014 |
| WO | WO 2014/165707 | A2 | 10/2014 |
| WO | WO 2014/165825 | A2 | 10/2014 |
| WO | WO 2014/172458 | A1 | 10/2014 |
| WO | WO 2014/172470 | A2 | 10/2014 |
| WO | WO 2014/172489 | A2 | 10/2014 |
| WO | WO 2014/173955 | A1 | 10/2014 |
| WO | WO 2014/182700 | A1 | 11/2014 |
| WO | WO 2014/183071 | A2 | 11/2014 |
| WO | WO 2014/184143 | A1 | 11/2014 |
| WO | WO 2014/184741 | A1 | 11/2014 |
| WO | WO 2014/184744 | A1 | 11/2014 |
| WO | WO 2014/186585 | A2 | 11/2014 |
| WO | WO 2014/186686 | A2 | 11/2014 |
| WO | WO 2014/190181 | A1 | 11/2014 |
| WO | WO 2014/191128 | A1 | 12/2014 |
| WO | WO 2014/191518 | A1 | 12/2014 |
| WO | WO 2014/191521 | A2 | 12/2014 |
| WO | WO 2014/191525 | A1 | 12/2014 |
| WO | WO 2014/191527 | A1 | 12/2014 |
| WO | WO 2014/193583 | A2 | 12/2014 |
| WO | WO 2014/194190 | A1 | 12/2014 |
| WO | WO 2014/197568 | A2 | 12/2014 |
| WO | WO 2014/197748 | A2 | 12/2014 |
| WO | WO 2014/199358 | A1 | 12/2014 |
| WO | WO 2014/200659 | A1 | 12/2014 |
| WO | WO 2014/201015 | A2 | 12/2014 |
| WO | WO 2014/204578 | A1 | 12/2014 |
| WO | WO 2014/204723 | A1 | 12/2014 |
| WO | WO 2014/204724 | A1 | 12/2014 |
| WO | WO 2014/204725 | A1 | 12/2014 |
| WO | WO 2014/204726 | A1 | 12/2014 |
| WO | WO 2014/204727 | A1 | 12/2014 |
| WO | WO 2014/204728 | A1 | 12/2014 |
| WO | WO 2014/204729 | A1 | 12/2014 |
| WO | WO 2014/205192 | A2 | 12/2014 |
| WO | WO 2014/207043 | A1 | 12/2014 |
| WO | WO 2015/002780 | A1 | 1/2015 |
| WO | WO 2015/004241 | A2 | 1/2015 |
| WO | WO 2015/006290 | A1 | 1/2015 |
| WO | WO 2015/006294 | A2 | 1/2015 |
| WO | WO 2015/006437 | A1 | 1/2015 |
| WO | WO 2015/006498 | A2 | 1/2015 |
| WO | WO 2015/006747 | A2 | 1/2015 |
| WO | WO 2015/007194 | A1 | 1/2015 |
| WO | WO 2015/010114 | A1 | 1/2015 |
| WO | WO 2015/011483 | A1 | 1/2015 |
| WO | WO 2015/013583 | A2 | 1/2015 |
| WO | WO 2015/017866 | A1 | 2/2015 |
| WO | WO 2015/018503 | A1 | 2/2015 |
| WO | WO 2015/021353 | A1 | 2/2015 |
| WO | WO 2015/021426 | A1 | 2/2015 |
| WO | WO 2015/021990 | A1 | 2/2015 |
| WO | WO 2015/024017 | A2 | 2/2015 |
| WO | WO 2015/024986 | A1 | 2/2015 |
| WO | WO 2015/026883 | A1 | 2/2015 |
| WO | WO 2015/026885 | A1 | 2/2015 |
| WO | WO 2015/026886 | A1 | 2/2015 |
| WO | WO 2015/026887 | A1 | 2/2015 |
| WO | WO 2015/027134 | A1 | 2/2015 |

(56) References Cited

FOREIGN PATENT DOCUMENTS

| | | | |
|---|---|---|---|
| WO | WO 2015/028969 | A2 | 3/2015 |
| WO | WO 2015/030881 | A1 | 3/2015 |
| WO | WO 2015/031619 | A1 | 3/2015 |
| WO | WO 2015/031775 | A1 | 3/2015 |
| WO | WO 2015/032494 | A2 | 3/2015 |
| WO | WO 2015/033293 | A1 | 3/2015 |
| WO | WO 2015/034872 | A2 | 3/2015 |
| WO | WO 2015/034885 | A1 | 3/2015 |
| WO | WO 2015/035136 | A2 | 3/2015 |
| WO | WO 2015/035139 | A2 | 3/2015 |
| WO | WO 2015/035162 | A2 | 3/2015 |
| WO | WO 2015/040075 | A1 | 3/2015 |
| WO | WO 2015/040402 | A1 | 3/2015 |
| WO | WO 2015/042393 | A2 | 3/2015 |
| WO | WO 2015/042585 | A1 | 3/2015 |
| WO | WO 2015/048577 | A2 | 4/2015 |
| WO | WO 2015/048690 | A1 | 4/2015 |
| WO | WO 2015/048707 | A2 | 4/2015 |
| WO | WO 2015/048801 | A2 | 4/2015 |
| WO | WO 2015/049897 | A1 | 4/2015 |
| WO | WO 2015/051191 | A1 | 4/2015 |
| WO | WO 2015/052133 | A1 | 4/2015 |
| WO | WO 2015/052231 | A2 | 4/2015 |
| WO | WO 2015/052335 | A1 | 4/2015 |
| WO | WO 2015/053995 | A1 | 4/2015 |
| WO | WO 2015/054253 | A1 | 4/2015 |
| WO | WO 2015/054315 | A1 | 4/2015 |
| WO | WO 2015/057671 | A1 | 4/2015 |
| WO | WO 2015/057834 | A1 | 4/2015 |
| WO | WO 2015/057852 | A1 | 4/2015 |
| WO | WO 2015/057976 | A1 | 4/2015 |
| WO | WO 2015/057980 | A1 | 4/2015 |
| WO | WO 2015/059265 | A1 | 4/2015 |
| WO | WO 2015/065964 | A1 | 5/2015 |
| WO | WO 2015/066119 | A1 | 5/2015 |
| WO | WO 2015/066634 | A2 | 5/2015 |
| WO | WO 2015/066636 | A2 | 5/2015 |
| WO | WO 2015/066637 | A1 | 5/2015 |
| WO | WO 2015/066638 | A2 | 5/2015 |
| WO | WO 2015/066643 | A1 | 5/2015 |
| WO | WO 2015/069682 | A2 | 5/2015 |
| WO | WO 2015/070083 | A1 | 5/2015 |
| WO | WO 2015/070193 | A1 | 5/2015 |
| WO | WO 2015/070212 | A1 | 5/2015 |
| WO | WO 2015/071474 | A2 | 5/2015 |
| WO | WO 2015/073683 | A2 | 5/2015 |
| WO | WO 2015/073867 | A1 | 5/2015 |
| WO | WO 2015/073990 | A1 | 5/2015 |
| WO | WO 2015/075056 | A1 | 5/2015 |
| WO | WO 2015/075154 | A2 | 5/2015 |
| WO | WO 2015/075175 | A1 | 5/2015 |
| WO | WO 2015/075195 | A1 | 5/2015 |
| WO | WO 2015/075557 | A2 | 5/2015 |
| WO | WO 2015/077058 | A2 | 5/2015 |
| WO | WO 2015/077290 | A2 | 5/2015 |
| WO | WO 2015/077318 | A1 | 5/2015 |
| WO | WO 2015/079056 | A1 | 6/2015 |
| WO | WO 2015/079057 | A2 | 6/2015 |
| WO | WO 2015/086795 | A1 | 6/2015 |
| WO | WO 2015/086798 | A2 | 6/2015 |
| WO | WO 2015/088643 | A1 | 6/2015 |
| WO | WO 2015/089046 | A1 | 6/2015 |
| WO | WO 2015/089077 | A2 | 6/2015 |
| WO | WO 2015/089277 | A1 | 6/2015 |
| WO | WO 2015/089351 | A1 | 6/2015 |
| WO | WO 2015/089354 | A1 | 6/2015 |
| WO | WO 2015/089364 | A1 | 6/2015 |
| WO | WO 2015/089406 | A1 | 6/2015 |
| WO | WO 2015/089419 | A2 | 6/2015 |
| WO | WO 2015/089427 | A1 | 6/2015 |
| WO | WO 2015/089462 | A1 | 6/2015 |
| WO | WO 2015/089465 | A1 | 6/2015 |
| WO | WO 2015/089473 | A1 | 6/2015 |
| WO | WO 2015/089486 | A1 | 6/2015 |
| WO | WO 2015/095804 | A1 | 6/2015 |
| WO | WO 2015/099850 | A1 | 7/2015 |
| WO | WO 2015/100929 | A1 | 7/2015 |
| WO | WO 2015/103057 | A1 | 7/2015 |
| WO | WO 2015/103153 | A1 | 7/2015 |
| WO | WO 2015/105928 | A1 | 7/2015 |
| WO | WO 2015/108993 | A1 | 7/2015 |
| WO | WO 2015/109752 | A1 | 7/2015 |
| WO | WO 2015/110474 | A1 | 7/2015 |
| WO | WO 2015/112790 | A2 | 7/2015 |
| WO | WO 2015/112896 | A2 | 7/2015 |
| WO | WO 2015/113063 | A1 | 7/2015 |
| WO | WO 2015/114365 | A1 | 8/2015 |
| WO | WO 2015/115903 | A1 | 8/2015 |
| WO | WO 2015/116686 | A1 | 8/2015 |
| WO | WO 2015/116969 | A2 | 8/2015 |
| WO | WO 2015/117021 | A1 | 8/2015 |
| WO | WO 2015/117041 | A1 | 8/2015 |
| WO | WO 2015/117081 | A2 | 8/2015 |
| WO | WO 2015/118156 | A1 | 8/2015 |
| WO | WO 2015/119941 | A2 | 8/2015 |
| WO | WO 2015/121454 | A1 | 8/2015 |
| WO | WO 2015/122967 | A1 | 8/2015 |
| WO | WO 2015/123339 | A1 | 8/2015 |
| WO | WO 2015/124715 | A1 | 8/2015 |
| WO | WO 2015/124718 | A1 | 8/2015 |
| WO | WO 2015/126927 | A2 | 8/2015 |
| WO | WO 2015/127428 | A1 | 8/2015 |
| WO | WO 2015/127439 | A1 | 8/2015 |
| WO | WO 2015/129686 | A1 | 9/2015 |
| WO | WO 2015/131101 | A1 | 9/2015 |
| WO | WO 2015/133554 | A1 | 9/2015 |
| WO | WO 2015/134121 | A2 | 9/2015 |
| WO | WO 2015/134812 | A1 | 9/2015 |
| WO | WO 2015/136001 | A1 | 9/2015 |
| WO | WO 2015/138510 | A1 | 9/2015 |
| WO | WO 2015/138739 | A2 | 9/2015 |
| WO | WO 2015/138855 | A1 | 9/2015 |
| WO | WO 2015/138870 | A2 | 9/2015 |
| WO | WO 2015/139008 | A1 | 9/2015 |
| WO | WO 2015/139139 | A1 | 9/2015 |
| WO | WO 2015/143046 | A2 | 9/2015 |
| WO | WO 2015/143177 | A1 | 9/2015 |
| WO | WO 2015/145417 | A1 | 10/2015 |
| WO | WO 2015/148431 | A1 | 10/2015 |
| WO | WO 2015/148670 | A1 | 10/2015 |
| WO | WO 2015/148680 | A1 | 10/2015 |
| WO | WO 2015/148760 | A1 | 10/2015 |
| WO | WO 2015/148761 | A1 | 10/2015 |
| WO | WO 2015/148860 | A1 | 10/2015 |
| WO | WO 2015/148863 | A2 | 10/2015 |
| WO | WO 2015/153760 | A2 | 10/2015 |
| WO | WO 2015/153780 | A1 | 10/2015 |
| WO | WO 2015/153789 | A1 | 10/2015 |
| WO | WO 2015/153791 | A1 | 10/2015 |
| WO | WO 2015/153889 | A2 | 10/2015 |
| WO | WO 2015/153940 | A1 | 10/2015 |
| WO | WO 2015/155341 | A1 | 10/2015 |
| WO | WO 2015/155686 | A2 | 10/2015 |
| WO | WO 2015/157070 | A2 | 10/2015 |
| WO | WO 2015/157534 | A1 | 10/2015 |
| WO | WO 2015/159068 | A1 | 10/2015 |
| WO | WO 2015/159086 | A1 | 10/2015 |
| WO | WO 2015/159087 | A1 | 10/2015 |
| WO | WO 2015/160683 | A1 | 10/2015 |
| WO | WO 2015/161276 | A2 | 10/2015 |
| WO | WO 2015/163733 | A1 | 10/2015 |
| WO | WO 2015/164740 | A1 | 10/2015 |
| WO | WO 2015/164748 | A1 | 10/2015 |
| WO | WO 2015/165274 | A1 | 11/2015 |
| WO | WO 2015/165275 | A1 | 11/2015 |
| WO | WO 2015/165276 | A1 | 11/2015 |
| WO | WO 2015/166272 | A2 | 11/2015 |
| WO | WO 2015/167766 | A1 | 11/2015 |
| WO | WO 2015/167956 | A1 | 11/2015 |
| WO | WO 2015/168125 | A1 | 11/2015 |
| WO | WO 2015/168158 | A1 | 11/2015 |
| WO | WO 2015/168404 | A1 | 11/2015 |
| WO | WO 2015/168547 | A2 | 11/2015 |
| WO | WO 2015/168800 | A1 | 11/2015 |

(56) References Cited

FOREIGN PATENT DOCUMENTS

| | | | |
|---|---|---|---|
| WO | WO 2015/171603 | A1 | 11/2015 |
| WO | WO 2015/171894 | A1 | 11/2015 |
| WO | WO 2015/171932 | A1 | 11/2015 |
| WO | WO 2015/172128 | A1 | 11/2015 |
| WO | WO 2015/173436 | A1 | 11/2015 |
| WO | WO 2015/175642 | A2 | 11/2015 |
| WO | WO 2015/179540 | A1 | 11/2015 |
| WO | WO 2015/183025 | A1 | 12/2015 |
| WO | WO 2015/183026 | A1 | 12/2015 |
| WO | WO 2015/183885 | A1 | 12/2015 |
| WO | WO 2015/184259 | A1 | 12/2015 |
| WO | WO 2015/184262 | A1 | 12/2015 |
| WO | WO 2015/184268 | A1 | 12/2015 |
| WO | WO 2015/188056 | A1 | 12/2015 |
| WO | WO 2015/188065 | A1 | 12/2015 |
| WO | WO 2015/188094 | A1 | 12/2015 |
| WO | WO 2015/188109 | A1 | 12/2015 |
| WO | WO 2015/188132 | A1 | 12/2015 |
| WO | WO 2015/188135 | A1 | 12/2015 |
| WO | WO 2015/188191 | A1 | 12/2015 |
| WO | WO 2015/189693 | A1 | 12/2015 |
| WO | WO 2015/191693 | A2 | 12/2015 |
| WO | WO 2015/191899 | A1 | 12/2015 |
| WO | WO 2015/191911 | A2 | 12/2015 |
| WO | WO 2015/193858 | A1 | 12/2015 |
| WO | WO 2015/195547 | A1 | 12/2015 |
| WO | WO 2015/195621 | A1 | 12/2015 |
| WO | WO 2015/195798 | A1 | 12/2015 |
| WO | WO 2015/198020 | A1 | 12/2015 |
| WO | WO 2015/200334 | A1 | 12/2015 |
| WO | WO 2015/200378 | A1 | 12/2015 |
| WO | WO 2015/200555 | A2 | 12/2015 |
| WO | WO 2015/200805 | A2 | 12/2015 |
| WO | WO 2016/001978 | A1 | 1/2016 |
| WO | WO 2016/004010 | A1 | 1/2016 |
| WO | WO 2016/004318 | A1 | 1/2016 |
| WO | WO 2016/007347 | A1 | 1/2016 |
| WO | WO 2016/007604 | A1 | 1/2016 |
| WO | WO 2016/007948 | A1 | 1/2016 |
| WO | WO 2016/011080 | A2 | 1/2016 |
| WO | WO 2016/011210 | A2 | 1/2016 |
| WO | WO 2016/011428 | A1 | 1/2016 |
| WO | WO 2016/012544 | A2 | 1/2016 |
| WO | WO 2016/012552 | A1 | 1/2016 |
| WO | WO 2016/014409 | A1 | 1/2016 |
| WO | WO 2016/014565 | A2 | 1/2016 |
| WO | WO 2016/014794 | A1 | 1/2016 |
| WO | WO 2016/014837 | A1 | 1/2016 |
| WO | WO 2016/016119 | A1 | 2/2016 |
| WO | WO 2016/016358 | A1 | 2/2016 |
| WO | WO 2016/019144 | A2 | 2/2016 |
| WO | WO 2016/020399 | A1 | 2/2016 |
| WO | WO 2016/021972 | A1 | 2/2016 |
| WO | WO 2016/021973 | A1 | 2/2016 |
| WO | WO 2016/022363 | A2 | 2/2016 |
| WO | WO 2016/022866 | A1 | 2/2016 |
| WO | WO 2016/022931 | A1 | 2/2016 |
| WO | WO 2016/025131 | A1 | 2/2016 |
| WO | WO 2016/025469 | A1 | 2/2016 |
| WO | WO 2016/025759 | A1 | 2/2016 |
| WO | WO 2016/026444 | A1 | 2/2016 |
| WO | WO 2016/028682 | A1 | 2/2016 |
| WO | WO 2016/028843 | A1 | 2/2016 |
| WO | WO 2016/028887 | A1 | 2/2016 |
| WO | WO 2016/033088 | A1 | 3/2016 |
| WO | WO 2016/033230 | A1 | 3/2016 |
| WO | WO 2016/033246 | A1 | 3/2016 |
| WO | WO 2016/033298 | A1 | 3/2016 |
| WO | WO 2016/035044 | A1 | 3/2016 |
| WO | WO 2016/035918 | A1 | 3/2016 |
| WO | WO 2016/036754 | A1 | 3/2016 |
| WO | WO 2016/037157 | A2 | 3/2016 |
| WO | WO 2016/040030 | A1 | 3/2016 |
| WO | WO 2016/040594 | A1 | 3/2016 |
| WO | WO 2016/044182 | A1 | 3/2016 |
| WO | WO 2016/044416 | A1 | 3/2016 |
| WO | WO 2016/046635 | A1 | 3/2016 |
| WO | WO 2016/049024 | A2 | 3/2016 |
| WO | WO 2016/049163 | A2 | 3/2016 |
| WO | WO 2016/049230 | A1 | 3/2016 |
| WO | WO 2016/049251 | A1 | 3/2016 |
| WO | WO 2016/049258 | A2 | 3/2016 |
| WO | WO 2016/053397 | A2 | 4/2016 |
| WO | WO 2016/054326 | A1 | 4/2016 |
| WO | WO 2016/057061 | A2 | 4/2016 |
| WO | WO 2016/057821 | A2 | 4/2016 |
| WO | WO 2016/057835 | A2 | 4/2016 |
| WO | WO 2016/057850 | A1 | 4/2016 |
| WO | WO 2016/057951 | A2 | 4/2016 |
| WO | WO 2016/057961 | A1 | 4/2016 |
| WO | WO 2016/061073 | A1 | 4/2016 |
| WO | WO 2016/061374 | A1 | 4/2016 |
| WO | WO 2016/061481 | A1 | 4/2016 |
| WO | WO 2016/061523 | A1 | 4/2016 |
| WO | WO 2016/064894 | A2 | 4/2016 |
| WO | WO 2016/065364 | A1 | 4/2016 |
| WO | WO 2016/069282 | A1 | 5/2016 |
| WO | WO 2016/069283 | A1 | 5/2016 |
| WO | WO 2016/069591 | A2 | 5/2016 |
| WO | WO 2016/069774 | A1 | 5/2016 |
| WO | WO 2016/069910 | A1 | 5/2016 |
| WO | WO 2016/069912 | A1 | 5/2016 |
| WO | WO 2016/070037 | A2 | 5/2016 |
| WO | WO 2016/070070 | A1 | 5/2016 |
| WO | WO 2016/070129 | A1 | 5/2016 |
| WO | WO 2016/072399 | A1 | 5/2016 |
| WO | WO 2016/072936 | A1 | 5/2016 |
| WO | WO 2016/073433 | A1 | 5/2016 |
| WO | WO 2016/073559 | A1 | 5/2016 |
| WO | WO 2016/073990 | A2 | 5/2016 |
| WO | WO 2016/075662 | A2 | 5/2016 |
| WO | WO 2016/076672 | A1 | 5/2016 |
| WO | WO 2016/077273 | A1 | 5/2016 |
| WO | WO 2016/077350 | A1 | 5/2016 |
| WO | WO 2016/080097 | A1 | 5/2016 |
| WO | WO 2016/080795 | A1 | 5/2016 |
| WO | WO 2016/081923 | A2 | 5/2016 |
| WO | WO 2016/081924 | A1 | 5/2016 |
| WO | WO 2016/082135 | A1 | 6/2016 |
| WO | WO 2016/083811 | A1 | 6/2016 |
| WO | WO 2016/084084 | A1 | 6/2016 |
| WO | WO 2016/084088 | A1 | 6/2016 |
| WO | WO 2016/086177 | A2 | 6/2016 |
| WO | WO 2016/089433 | A1 | 6/2016 |
| WO | WO 2016/089866 | A1 | 6/2016 |
| WO | WO 2016/089883 | A1 | 6/2016 |
| WO | WO 2016/090385 | A1 | 6/2016 |
| WO | WO 2016/094679 | A1 | 6/2016 |
| WO | WO 2016/094845 | A2 | 6/2016 |
| WO | WO 2016/094867 | A1 | 6/2016 |
| WO | WO 2016/094872 | A1 | 6/2016 |
| WO | WO 2016/094874 | A1 | 6/2016 |
| WO | WO 2016/094880 | A1 | 6/2016 |
| WO | WO 2016/094888 | A1 | 6/2016 |
| WO | WO 2016/097212 | A1 | 6/2016 |
| WO | WO 2016/097231 | A2 | 6/2016 |
| WO | WO 2016/097751 | A1 | 6/2016 |
| WO | WO 2016/099887 | A1 | 6/2016 |
| WO | WO 2016/100272 | A1 | 6/2016 |
| WO | WO 2016/100389 | A1 | 6/2016 |
| WO | WO 2016/100568 | A1 | 6/2016 |
| WO | WO 2016/100571 | A1 | 6/2016 |
| WO | WO 2016/100951 | A2 | 6/2016 |
| WO | WO 2016/100955 | A2 | 6/2016 |
| WO | WO 2016/100974 | A1 | 6/2016 |
| WO | WO 2016/103233 | A2 | 6/2016 |
| WO | WO 2016/104716 | A1 | 6/2016 |
| WO | WO 2016/106236 | A1 | 6/2016 |
| WO | WO 2016/106239 | A1 | 6/2016 |
| WO | WO 2016/106244 | A1 | 6/2016 |
| WO | WO 2016/106338 | A2 | 6/2016 |
| WO | WO 2016/108926 | A1 | 7/2016 |
| WO | WO 2016/109255 | A1 | 7/2016 |
| WO | WO 2016/109840 | A2 | 7/2016 |

(56) References Cited

FOREIGN PATENT DOCUMENTS

WO WO 2016/110214 A1 7/2016
WO WO 2016/110453 A1 7/2016
WO WO 2016/110511 A1 7/2016
WO WO 2016/110512 A1 7/2016
WO WO 2016/111546 A2 7/2016
WO WO 2016/112242 A1 7/2016
WO WO 2016/112351 A1 7/2016
WO WO 2016/112963 A1 7/2016
WO WO 2016/113357 A1 7/2016
WO WO 2016/114972 A1 7/2016
WO WO 2016/115179 A1 7/2016
WO WO 2016/115326 A1 7/2016
WO WO 2016/115355 A1 7/2016
WO WO 2016/116032 A1 7/2016
WO WO 2016/120480 A1 8/2016
WO WO 2016/123071 A1 8/2016
WO WO 2016/123230 A1 8/2016
WO WO 2016/123243 A1 8/2016
WO WO 2016/123578 A1 8/2016
WO WO 2016/126747 A1 8/2016
WO WO 2016/130600 A2 8/2016
WO WO 2016/130697 A1 8/2016
WO WO 2016/131009 A1 8/2016
WO WO 2016/132122 A1 8/2016
WO WO 2016/133165 A1 8/2016
WO WO 2016/135507 A1 9/2016
WO WO 2016/135557 A2 9/2016
WO WO 2016/135558 A2 9/2016
WO WO 2016/135559 A2 9/2016
WO WO 2016/137774 A1 9/2016
WO WO 2016/137949 A1 9/2016
WO WO 2016/141224 A1 9/2016
WO WO 2016/141893 A1 9/2016
WO WO 2016/142719 A1 9/2016
WO WO 2016/145150 A2 9/2016
WO WO 2016/148994 A1 9/2016
WO WO 2016/149484 A2 9/2016
WO WO 2016/149547 A1 9/2016
WO WO 2016/150336 A1 9/2016
WO WO 2016/150855 A1 9/2016
WO WO 2016/154016 A2 9/2016
WO WO 2016/154579 A2 9/2016
WO WO 2016/154596 A1 9/2016
WO WO 2016/155482 A1 10/2016
WO WO 2016/161004 A1 10/2016
WO WO 2016/161207 A1 10/2016
WO WO 2016/161260 A1 10/2016
WO WO 2016/161380 A1 10/2016
WO WO 2016/161446 A1 10/2016
WO WO 2016/164305 A1 10/2016
WO WO 2016/164356 A1 10/2016
WO WO 2016/164797 A1 10/2016
WO WO 2016/166340 A1 10/2016
WO WO 2016/167300 A1 10/2016
WO WO 2016/168631 A1 10/2016
WO WO 2016/170484 A1 10/2016
WO WO 2016/172359 A2 10/2016
WO WO 2016/172727 A1 10/2016
WO WO 2016/174056 A1 11/2016
WO WO 2016/174151 A1 11/2016
WO WO 2016/174250 A1 11/2016
WO WO 2016/176191 A1 11/2016
WO WO 2016/176404 A1 11/2016
WO WO 2016/176690 A2 11/2016
WO WO 2016/177682 A1 11/2016
WO WO 2016/178207 A1 11/2016
WO WO 2016/179038 A1 11/2016
WO WO 2016/179112 A1 11/2016
WO WO 2016/181357 A1 11/2016
WO WO 2016/182893 A1 11/2016
WO WO 2016/182917 A1 11/2016
WO WO 2016/182959 A1 11/2016
WO WO 2016/183236 A1 11/2016
WO WO 2016/183298 A2 11/2016
WO WO 2016/183345 A1 11/2016
WO WO 2016/183402 A2 11/2016
WO WO 2016/183438 A1 11/2016
WO WO 2016/183448 A1 11/2016
WO WO 2016/184955 A2 11/2016
WO WO 2016/184989 A1 11/2016
WO WO 2016/185411 A1 11/2016
WO WO 2016/186745 A1 11/2016
WO WO 2016/186772 A2 11/2016
WO WO 2016/186946 A1 11/2016
WO WO 2016/186953 A1 11/2016
WO WO 2016/187717 A1 12/2016
WO WO 2016/187904 A1 12/2016
WO WO 2016/191684 A1 12/2016
WO WO 2016/191869 A1 12/2016
WO WO 2016/196273 A1 12/2016
WO WO 2016/196282 A1 12/2016
WO WO 2016/196308 A1 12/2016
WO WO 2016/196361 A1 12/2016
WO WO 2016/196499 A1 12/2016
WO WO 2016/196539 A2 12/2016
WO WO 2016/196655 A1 12/2016
WO WO 2016/196805 A1 12/2016
WO WO 2016/196887 A1 12/2016
WO WO 2016/197132 A1 12/2016
WO WO 2016/197133 A1 12/2016
WO WO 2016/197354 A1 12/2016
WO WO 2016/197355 A1 12/2016
WO WO 2016/197356 A1 12/2016
WO WO 2016/197357 A1 12/2016
WO WO 2016/197358 A1 12/2016
WO WO 2016/197359 A1 12/2016
WO WO 2016/197360 A1 12/2016
WO WO 2016/197361 A1 12/2016
WO WO 2016/197362 A1 12/2016
WO WO 2016/198361 A1 12/2016
WO WO 2016/198500 A1 12/2016
WO WO 2016/200263 A1 12/2016
WO WO 2016/201047 A1 12/2016
WO WO 2016/201138 A1 12/2016
WO WO 2016/201152 A1 12/2016
WO WO 2016/201153 A1 12/2016
WO WO 2016/201155 A1 12/2016
WO WO 2016/205276 A1 12/2016
WO WO 2016/205613 A1 12/2016
WO WO 2016/205623 A1 12/2016
WO WO 2016/205680 A1 12/2016
WO WO 2016/205688 A2 12/2016
WO WO 2016/205703 A1 12/2016
WO WO 2016/205711 A1 12/2016
WO WO 2016/205728 A1 12/2016
WO WO 2016/205745 A2 12/2016
WO WO 2016/205749 A1 12/2016
WO WO 2016/205759 A1 12/2016
WO WO 2016/205764 A1 12/2016
WO WO 2017/001572 A1 1/2017
WO WO 2017/001988 A1 1/2017
WO WO 2017/004261 A1 1/2017
WO WO 2017/004279 A2 1/2017
WO WO 2017/004616 A1 1/2017
WO WO 2017/005807 A1 1/2017
WO WO 2017/009399 A1 1/2017
WO WO 2017/010556 A1 1/2017
WO WO 2017/011519 A1 1/2017
WO WO 2017/011721 A1 1/2017
WO WO 2017/011804 A1 1/2017
WO WO 2017/015015 A1 1/2017
WO WO 2017/015101 A1 1/2017
WO WO 2017/015545 A1 1/2017
WO WO 2017/015567 A1 1/2017
WO WO 2017/015637 A1 1/2017
WO WO 2017/017016 A1 2/2017
WO WO 2017/019867 A1 2/2017
WO WO 2017/019895 A1 2/2017
WO WO 2017/023803 A1 2/2017
WO WO 2017/023974 A1 2/2017
WO WO 2017/024047 A1 2/2017
WO WO 2017/024319 A1 2/2017
WO WO 2017/024343 A1 2/2017
WO WO 2017/024602 A1 2/2017

(56) References Cited

FOREIGN PATENT DOCUMENTS

| | | | |
|---|---|---|---|
| WO | WO 2017/025323 | A1 | 2/2017 |
| WO | WO 2017/027423 | A1 | 2/2017 |
| WO | WO 2017/028768 | A1 | 2/2017 |
| WO | WO 2017/029664 | A1 | 2/2017 |
| WO | WO 2017/031360 | A1 | 2/2017 |
| WO | WO 2017/031483 | A1 | 2/2017 |
| WO | WO 2017/035416 | A2 | 3/2017 |
| WO | WO 2017/040348 | A1 | 3/2017 |
| WO | WO 2017/040511 | A1 | 3/2017 |
| WO | WO 2017/040709 | A1 | 3/2017 |
| WO | WO 2017/040786 | A1 | 3/2017 |
| WO | WO 2017/040793 | A1 | 3/2017 |
| WO | WO 2017/040813 | A2 | 3/2017 |
| WO | WO 2017/043573 | A1 | 3/2017 |
| WO | WO 2017/043656 | A1 | 3/2017 |
| WO | WO 2017/044419 | A1 | 3/2017 |
| WO | WO 2017/044776 | A1 | 3/2017 |
| WO | WO 2017/044857 | A2 | 3/2017 |
| WO | WO 2017/048390 | A1 | 3/2017 |
| WO | WO 2017/049129 | A2 | 3/2017 |
| WO | WO 2017/050963 | A1 | 3/2017 |
| WO | WO 2017/053312 | A1 | 3/2017 |
| WO | WO 2017/053431 | A2 | 3/2017 |
| WO | WO 2017/053713 | A1 | 3/2017 |
| WO | WO 2017/053729 | A1 | 3/2017 |
| WO | WO 2017/053753 | A1 | 3/2017 |
| WO | WO 2017/053762 | A1 | 3/2017 |
| WO | WO 2017/053879 | A1 | 3/2017 |
| WO | WO 2017/054721 | A1 | 4/2017 |
| WO | WO 2017/058658 | A2 | 4/2017 |
| WO | WO 2017/059241 | A1 | 4/2017 |
| WO | WO 2017/062605 | A1 | 4/2017 |
| WO | WO 2017/062723 | A1 | 4/2017 |
| WO | WO 2017/062754 | A1 | 4/2017 |
| WO | WO 2017/062855 | A1 | 4/2017 |
| WO | WO 2017/062886 | A1 | 4/2017 |
| WO | WO 2017/062983 | A1 | 4/2017 |
| WO | WO 2017/064439 | A1 | 4/2017 |
| WO | WO 2017/064546 | A1 | 4/2017 |
| WO | WO 2017/064566 | A2 | 4/2017 |
| WO | WO 2017/066175 | A1 | 4/2017 |
| WO | WO 2017/066497 | A2 | 4/2017 |
| WO | WO 2017/066588 | A2 | 4/2017 |
| WO | WO 2017/066707 | A1 | 4/2017 |
| WO | WO 2017/066781 | A1 | 4/2017 |
| WO | WO 2017/068077 | A1 | 4/2017 |
| WO | WO 2017/068377 | A1 | 4/2017 |
| WO | WO 2017/069829 | A2 | 4/2017 |
| WO | WO 2017/070029 | A1 | 4/2017 |
| WO | WO 2017/070032 | A1 | 4/2017 |
| WO | WO 2017/070169 | A1 | 4/2017 |
| WO | WO 2017/070284 | A1 | 4/2017 |
| WO | WO 2017/070598 | A1 | 4/2017 |
| WO | WO 2017/070605 | A1 | 4/2017 |
| WO | WO 2017/070632 | A2 | 4/2017 |
| WO | WO 2017/070633 | A2 | 4/2017 |
| WO | WO 2017/072590 | A1 | 5/2017 |
| WO | WO 2017/074526 | A1 | 5/2017 |
| WO | WO 2017/074962 | A1 | 5/2017 |
| WO | WO 2017/075261 | A1 | 5/2017 |
| WO | WO 2017/075335 | A1 | 5/2017 |
| WO | WO 2017/075475 | A1 | 5/2017 |
| WO | WO 2017/077135 | A1 | 5/2017 |
| WO | WO 2017/077329 | A2 | 5/2017 |
| WO | WO 2017/078751 | A1 | 5/2017 |
| WO | WO 2017/079400 | A1 | 5/2017 |
| WO | WO 2017/079428 | A1 | 5/2017 |
| WO | WO 2017/079673 | A1 | 5/2017 |
| WO | WO 2017/079724 | A1 | 5/2017 |
| WO | WO 2017/081097 | A1 | 5/2017 |
| WO | WO 2017/081288 | A1 | 5/2017 |
| WO | WO 2017/083368 | A1 | 5/2017 |
| WO | WO 2017/083722 | A1 | 5/2017 |
| WO | WO 2017/083766 | A1 | 5/2017 |
| WO | WO 2017/087395 | A1 | 5/2017 |
| WO | WO 2017/090724 | A1 | 6/2017 |
| WO | WO 2017/091510 | A1 | 6/2017 |
| WO | WO 2017/091630 | A1 | 6/2017 |
| WO | WO 2017/092201 | A1 | 6/2017 |
| WO | WO 2017/093370 | A1 | 6/2017 |
| WO | WO 2017/093969 | A1 | 6/2017 |
| WO | WO 2017/095111 | A1 | 6/2017 |
| WO | WO 2017/096041 | A1 | 6/2017 |
| WO | WO 2017/096237 | A1 | 6/2017 |
| WO | WO 2017/100158 | A1 | 6/2017 |
| WO | WO 2017/100431 | A2 | 6/2017 |
| WO | WO 2017/104404 | A1 | 6/2017 |
| WO | WO 2017/105251 | A1 | 6/2017 |
| WO | WO 2017/105350 | A1 | 6/2017 |
| WO | WO 2017/105991 | A1 | 6/2017 |
| WO | WO 2017/106414 | A1 | 6/2017 |
| WO | WO 2017/106528 | A2 | 6/2017 |
| WO | WO 2017/106537 | A2 | 6/2017 |
| WO | WO 2017/106569 | A1 | 6/2017 |
| WO | WO 2017/106616 | A1 | 6/2017 |
| WO | WO 2017/106657 | A1 | 6/2017 |
| WO | WO 2017/106767 | A1 | 6/2017 |
| WO | WO 2017/109134 | A1 | 6/2017 |
| WO | WO 2017/109757 | A1 | 6/2017 |
| WO | WO 2017/112620 | A1 | 6/2017 |
| WO | WO 2017/115268 | A1 | 7/2017 |
| WO | WO 2017/117395 | A1 | 7/2017 |
| WO | WO 2017/118598 | A1 | 7/2017 |
| WO | WO 2017/118720 | A1 | 7/2017 |
| WO | WO 2017/123609 | A1 | 7/2017 |
| WO | WO 2017/123910 | A1 | 7/2017 |
| WO | WO 2017/124086 | A1 | 7/2017 |
| WO | WO 2017/124100 | A1 | 7/2017 |
| WO | WO 2017/124652 | A1 | 7/2017 |
| WO | WO 2017/126987 | A1 | 7/2017 |
| WO | WO 2017/127807 | A1 | 7/2017 |
| WO | WO 2017/131237 | A1 | 8/2017 |
| WO | WO 2017/132112 | A1 | 8/2017 |
| WO | WO 2017/132580 | A2 | 8/2017 |
| WO | WO 2017/136520 | A1 | 8/2017 |
| WO | WO 2017/136629 | A1 | 8/2017 |
| WO | WO 2017/136794 | A1 | 8/2017 |
| WO | WO 2017/139264 | A1 | 8/2017 |
| WO | WO 2017/139505 | A2 | 8/2017 |
| WO | WO 2017/141173 | A2 | 8/2017 |
| WO | WO 2017/142835 | A1 | 8/2017 |
| WO | WO 2017/142923 | A1 | 8/2017 |
| WO | WO 2017/142999 | A2 | 8/2017 |
| WO | WO 2017/143042 | A2 | 8/2017 |
| WO | WO 2017/147056 | A1 | 8/2017 |
| WO | WO 2017/147278 | A1 | 8/2017 |
| WO | WO 2017/147432 | A1 | 8/2017 |
| WO | WO 2017/147446 | A1 | 8/2017 |
| WO | WO 2017/147555 | A1 | 8/2017 |
| WO | WO 2017/151444 | A1 | 9/2017 |
| WO | WO 2017/151719 | A1 | 9/2017 |
| WO | WO 2017/152015 | A1 | 9/2017 |
| WO | WO 2017/155717 | A1 | 9/2017 |
| WO | WO 2017/157422 | A1 | 9/2017 |
| WO | WO 2017/158153 | A1 | 9/2017 |
| WO | WO 2017/160689 | A1 | 9/2017 |
| WO | WO 2017/160752 | A1 | 9/2017 |
| WO | WO 2017/160890 | A1 | 9/2017 |
| WO | WO 2017/161068 | A1 | 9/2017 |
| WO | WO 2017/165741 | A1 | 9/2017 |
| WO | WO 2017/165826 | A1 | 9/2017 |
| WO | WO 2017/165862 | A1 | 9/2017 |
| WO | WO 2017/167712 | A1 | 10/2017 |
| WO | WO 2017/172644 | A2 | 10/2017 |
| WO | WO 2017/172645 | A2 | 10/2017 |
| WO | WO 2017/172860 | A1 | 10/2017 |
| WO | WO 2017/173004 | A1 | 10/2017 |
| WO | WO 2017/173054 | A1 | 10/2017 |
| WO | WO 2017/173092 | A1 | 10/2017 |
| WO | WO 2017/174329 | A1 | 10/2017 |
| WO | WO 2017/176529 | A1 | 10/2017 |
| WO | WO 2017/176806 | A1 | 10/2017 |
| WO | WO 2017/178590 | A1 | 10/2017 |
| WO | WO 2017/180694 | A1 | 10/2017 |

(56) References Cited

FOREIGN PATENT DOCUMENTS

WO WO 2017/180711 A1 10/2017
WO WO 2017/180915 A2 10/2017
WO WO 2017/180926 A1 10/2017
WO WO 2017/181107 A2 10/2017
WO WO 2017/181735 A2 10/2017
WO WO 2017/182468 A1 10/2017
WO WO 2017/182585 A1 10/2017
WO WO 2017/182607 A1 10/2017
WO WO 2017/184334 A1 10/2017
WO WO 2017/184768 A1 10/2017
WO WO 2017/184786 A1 10/2017
WO WO 2017/186550 A1 11/2017
WO WO 2017/189308 A1 11/2017
WO WO 2017/189336 A1 11/2017
WO WO 2017/190041 A1 11/2017
WO WO 2017/190257 A1 11/2017
WO WO 2017/190664 A1 11/2017
WO WO 2017/191210 A1 11/2017
WO WO 2017/191274 A2 11/2017
WO WO 2017/192172 A1 11/2017
WO WO 2017/192512 A2 11/2017
WO WO 2017/192544 A1 11/2017
WO WO 2017/192573 A1 11/2017
WO WO 2017/193029 A2 11/2017
WO WO 2017/193053 A1 11/2017
WO WO 2017/196768 A1 11/2017
WO WO 2017/197038 A1 11/2017
WO WO 2017/197238 A1 11/2017
WO WO 2017/197301 A1 11/2017
WO WO 2017/201476 A1 11/2017
WO WO 2017/205290 A1 11/2017
WO WO 2017/205423 A1 11/2017
WO WO 2017/207589 A1 12/2017
WO WO 2017/208247 A1 12/2017
WO WO 2017/209809 A1 12/2017
WO WO 2017/213896 A1 12/2017
WO WO 2017/213898 A2 12/2017
WO WO 2017/214460 A1 12/2017
WO WO 2017/216392 A1 12/2017
WO WO 2017/216771 A2 12/2017
WO WO 2017/218185 A1 12/2017
WO WO 2017/219027 A1 12/2017
WO WO 2017/219033 A1 12/2017
WO WO 2017/220751 A1 12/2017
WO WO 2017/222370 A1 12/2017
WO WO 2017/222773 A1 12/2017
WO WO 2017/222834 A1 12/2017
WO WO 2017/223107 A1 12/2017
WO WO 2017/223330 A1 12/2017
WO WO 2018/000657 A1 1/2018
WO WO 2018/002719 A1 1/2018
WO WO 2018/005117 A1 1/2018
WO WO 2018/005289 A2 1/2018
WO WO 2018/005691 A1 1/2018
WO WO 2018/005782 A1 1/2018
WO WO 2018/005873 A1 1/2018
WO WO 2018/06693 A1 1/2018
WO WO 2018/009520 A1 1/2018
WO WO 2018/009562 A1 1/2018
WO WO 2018/009822 A1 1/2018
WO WO 2018/013821 A1 1/2018
WO WO 2018/013932 A1 1/2018
WO WO 2018/013990 A1 1/2018
WO WO 2018/014384 A1 1/2018
WO WO 2018/015444 A1 1/2018
WO WO 2018/015936 A2 1/2018
WO WO 2018/017754 A1 1/2018
WO WO 2018/018979 A1 2/2018
WO WO 2018/020248 A1 2/2018
WO WO 2018/021878 A1 2/2018
WO WO 2018/022480 A1 2/2018
WO WO 2018/022634 A1 2/2018
WO WO 2018/025206 A1 2/2018
WO WO 2018/026723 A1 2/2018
WO WO 2018/026976 A1 2/2018
WO WO 2018/027078 A1 2/2018
WO WO 2018/030608 A1 2/2018
WO WO 2018/031683 A1 2/2018
WO WO 2018/035250 A1 2/2018
WO WO 2018/035300 A1 2/2018
WO WO 2018/035423 A1 2/2018
WO WO 2018/035503 A1 2/2018
WO WO 2018/039145 A1 3/2018
WO WO 2018/039438 A1 3/2018
WO WO 2018/039440 A1 3/2018
WO WO 2018/039448 A1 3/2018
WO WO 2018/045630 A1 3/2018
WO WO 2018/048827 A1 3/2018
WO WO 2018/049073 A1 3/2018
WO WO 2018/049168 A1 3/2018
WO WO 2018/051347 A1 3/2018
WO WO 2018/058064 A1 3/2018
WO WO 2018/062866 A2 4/2018
WO WO 2018/064352 A1 4/2018
WO WO 2018/064371 A1 4/2018
WO WO 2018/064516 A1 4/2018
WO WO 2018/067546 A1 4/2018
WO WO 2018/067846 A1 4/2018
WO WO 2018/068053 A2 4/2018
WO WO 2018/069474 A1 4/2018
WO WO 2018/071623 A2 4/2018
WO WO 2018/071663 A1 4/2018
WO WO 2018/071868 A1 4/2018
WO WO 2018/071892 A1 4/2018
WO WO 2018/074979 A1 4/2018
WO WO 2018/079134 A1 5/2018
WO WO 2018/080573 A1 5/2018
WO WO 2018/081504 A1 5/2018
WO WO 2018/081535 A2 5/2018
WO WO 2018/081728 A1 5/2018
WO WO 2018/083128 A2 5/2018
WO WO 2018/083606 A1 5/2018
WO WO 2018/085288 A1 5/2018
WO WO 2018/085414 A1 5/2018
WO WO 2018/085842 A1 5/2018
WO WO 2018/086623 A1 5/2018
WO WO 2018/089664 A1 5/2018
WO WO 2018/093990 A1 5/2018
WO WO 2018/098383 A1 5/2018
WO WO 2018/098480 A1 5/2018
WO WO 2018/098587 A1 6/2018
WO WO 2018/099256 A1 6/2018
WO WO 2018/103686 A1 6/2018
WO WO 2018/106268 A1 6/2018
WO WO 2018/107028 A1 6/2018
WO WO 2018/107103 A1 6/2018
WO WO 2018/107129 A1 6/2018
WO WO 2018/108272 A1 6/2018
WO WO 2018/109101 A1 6/2018
WO WO 2018/111946 A1 6/2018
WO WO 2018/111947 A1 6/2018
WO WO 2018/112336 A1 6/2018
WO WO 2018/112446 A2 6/2018
WO WO 2018/119354 A1 6/2018
WO WO 2018/119359 A1 6/2018
WO WO 2018/120283 A1 7/2018
WO WO 2018/130830 A1 7/2018
WO WO 2018/135838 A2 7/2018
WO WO 2018/136396 A2 7/2018
WO WO 2018/138385 A1 8/2018
WO WO 2018/142364 A1 8/2018
WO WO 2018/148246 A1 8/2018
WO WO 2018/148256 A1 8/2018
WO WO 2018/148647 A2 8/2018
WO WO 2018/149418 A1 8/2018
WO WO 2018/149888 A1 8/2018
WO WO 2018/149915 A1 8/2018
WO WO 2018/152197 A1 8/2018
WO WO 2018/152418 A1 8/2018
WO WO 2018/154380 A1 8/2018
WO WO 2018/154387 A1 8/2018
WO WO 2018/154412 A1 8/2018
WO WO 2018/154413 A1 8/2018
WO WO 2018/154418 A1 8/2018

(56) References Cited

FOREIGN PATENT DOCUMENTS

| | | | |
|---|---|---|---|
| WO | WO 2018/154439 | A1 | 8/2018 |
| WO | WO 2018/154459 | A1 | 8/2018 |
| WO | WO 2018/154462 | A2 | 8/2018 |
| WO | WO 2018/156372 | A1 | 8/2018 |
| WO | WO 2018/156824 | A1 | 8/2018 |
| WO | WO 2018/161009 | A1 | 9/2018 |
| WO | WO 2018/161032 | A1 | 9/2018 |
| WO | WO 2018/165504 | A1 | 9/2018 |
| WO | WO 2018/165629 | A1 | 9/2018 |
| WO | WO 2018/170015 | A1 | 9/2018 |
| WO | WO 2018/170340 | A1 | 9/2018 |
| WO | WO 2018/175502 | A2 | 9/2018 |
| WO | WO 2018/176009 | A1 | 9/2018 |
| WO | WO 2018/177351 | A1 | 10/2018 |
| WO | WO 2018/179578 | A1 | 10/2018 |
| WO | WO 2018/183403 | A1 | 10/2018 |
| WO | WO 2018/189184 | A1 | 10/2018 |
| WO | WO 2018/191388 | A1 | 10/2018 |
| WO | WO 2018/195402 | A1 | 10/2018 |
| WO | WO 2018/195545 | A2 | 10/2018 |
| WO | WO 2018/195555 | A1 | 10/2018 |
| WO | WO 2018/197020 | A1 | 11/2018 |
| WO | WO 2018/197495 | A1 | 11/2018 |
| WO | WO 2018/200597 | A1 | 11/2018 |
| WO | WO 2018/202800 | A1 | 11/2018 |
| WO | WO 2018/204493 | A1 | 11/2018 |
| WO | WO 2018/208755 | A1 | 11/2018 |
| WO | WO 2018/208998 | A1 | 11/2018 |
| WO | WO 2018/209158 | A2 | 11/2018 |
| WO | WO 2018/209320 | A1 | 11/2018 |
| WO | WO 2018/213351 | A1 | 11/2018 |
| WO | WO 2018/213708 | A1 | 11/2018 |
| WO | WO 2018/213726 | A1 | 11/2018 |
| WO | WO 2018/213771 | A1 | 11/2018 |
| WO | WO 2018/213791 | A1 | 11/2018 |
| WO | WO 2018/217852 | A1 | 11/2018 |
| WO | WO 2018/217981 | A1 | 11/2018 |
| WO | WO 2018/218166 | A1 | 11/2018 |
| WO | WO 2018/218188 | A2 | 11/2018 |
| WO | WO 2018/218206 | A1 | 11/2018 |
| WO | WO 2018/226855 | A1 | 12/2018 |
| WO | WO 2019/005884 | A1 | 1/2019 |
| WO | WO 2019/005886 | A1 | 1/2019 |
| WO | WO 2019/010384 | A1 | 1/2019 |
| WO | WO 2019/023680 | A1 | 1/2019 |
| WO | WO 2019/042284 | A1 | 3/2019 |
| WO | WO 2019/051097 | A1 | 3/2019 |
| WO | WO 2019/067992 | A1 | 4/2019 |
| WO | WO 2019/075357 | A1 | 4/2019 |
| WO | WO 2019/079347 | A1 | 4/2019 |
| WO | WO 2019/084062 | A1 | 5/2019 |
| WO | WO 2019/090169 | A1 | 5/2019 |
| WO | WO 2019/090367 | A1 | 5/2019 |
| WO | WO 2019/092042 | A1 | 5/2019 |
| WO | WO 2019/118497 | A1 | 6/2019 |
| WO | WO 2019/118935 | A1 | 6/2019 |
| WO | WO 2019/118949 | A1 | 6/2019 |
| WO | WO 2019/123430 | A1 | 6/2019 |
| WO | WO 2019/126709 | A1 | 6/2019 |
| WO | WO 2019/139645 | A2 | 7/2019 |
| WO | WO 2019/139951 | A1 | 7/2019 |
| WO | WO 2019/147014 | A1 | 8/2019 |
| WO | WO 2019/161251 | A1 | 8/2019 |
| WO | WO 2019/168953 | A1 | 9/2019 |
| WO | WO 2019/183641 | A1 | 9/2019 |
| WO | WO 2019/204369 | A1 | 10/2019 |
| WO | WO 2019/213257 | A1 | 11/2019 |
| WO | WO 2019/217942 | A1 | 11/2019 |
| WO | WO 2019/217943 | A1 | 11/2019 |
| WO | WO 2019/226593 | A1 | 11/2019 |
| WO | WO 2019/226953 | A1 | 11/2019 |
| WO | WO 2019/236566 | A1 | 12/2019 |
| WO | WO 2019/241649 | A1 | 12/2019 |
| WO | WO 2020/014261 | A1 | 1/2020 |
| WO | WO 2020/028555 | A2 | 2/2020 |
| WO | WO 2020/028823 | A1 | 2/2020 |
| WO | WO 2020/041751 | A1 | 2/2020 |
| WO | WO 2020/047124 | A1 | 3/2020 |
| WO | WO 2020/051360 | A1 | 3/2020 |
| WO | WO 2020/081568 | A1 | 4/2020 |
| WO | WO 2020/086908 | A1 | 4/2020 |
| WO | WO 2020/092453 | A1 | 5/2020 |
| WO | WO 2020/102369 | A1 | 5/2020 |
| WO | WO 2020/102659 | A1 | 5/2020 |
| WO | WO 2020/102709 | A1 | 5/2020 |
| WO | WO 2020/154500 | A1 | 7/2020 |
| WO | WO 2020/157008 | A1 | 8/2020 |
| WO | WO 2020/160071 | A1 | 8/2020 |
| WO | WO 2020/160418 | A1 | 8/2020 |
| WO | WO 2020/160481 | A1 | 8/2020 |
| WO | WO 2020/160517 | A1 | 8/2020 |
| WO | WO 2020/180975 | A1 | 9/2020 |
| WO | WO 2020/181178 | A1 | 9/2020 |
| WO | WO 2020/181180 | A1 | 9/2020 |
| WO | WO 2020/181193 | A1 | 9/2020 |
| WO | WO 2020/181195 | A1 | 9/2020 |
| WO | WO 2020/181202 | A1 | 9/2020 |
| WO | WO 2020/191153 | A1 | 9/2020 |
| WO | WO 2020/191171 | A1 | 9/2020 |
| WO | WO 2020/191233 | A1 | 9/2020 |
| WO | WO 2020/191234 | A1 | 9/2020 |
| WO | WO 2020/191239 | A1 | 9/2020 |
| WO | WO 2020/191241 | A1 | 9/2020 |
| WO | WO 2020/191242 | A1 | 9/2020 |
| WO | WO 2020/191243 | A1 | 9/2020 |
| WO | WO 2020/191245 | A1 | 9/2020 |
| WO | WO 2020/191246 | A1 | 9/2020 |
| WO | WO 2020/191248 | A1 | 9/2020 |
| WO | WO 2020/191249 | A1 | 9/2020 |
| WO | WO 2020/193696 | A1 | 10/2020 |
| WO | WO 2020/205681 | A1 | 10/2020 |
| WO | WO 2020/210751 | A1 | 10/2020 |
| WO | WO 2020/214842 | A1 | 10/2020 |
| WO | WO 2020/225287 | A1 | 11/2020 |
| WO | WO 2020/236982 | A1 | 11/2020 |
| WO | WO 2020/247587 | A1 | 12/2020 |
| WO | WO 2020/247803 | A2 | 12/2020 |
| WO | WO 2021/022043 | A2 | 2/2021 |
| WO | WO 2021/025750 | A1 | 2/2021 |
| WO | WO 2021/030344 | A1 | 2/2021 |
| WO | WO 2021/030666 | A1 | 2/2021 |
| WO | WO 2021/042047 | A1 | 3/2021 |
| WO | WO 2021/042062 | A2 | 3/2021 |
| WO | WO 2021/046143 | A1 | 3/2021 |
| WO | WO 2021/072328 | A1 | 4/2021 |
| WO | WO 2021/080922 | A1 | 4/2021 |
| WO | WO 2021/081264 | A1 | 4/2021 |
| WO | WO 2021/087182 | A1 | 5/2021 |
| WO | WO 2021/087401 | A1 | 5/2021 |
| WO | WO 2021/108717 | A2 | 6/2021 |
| WO | WO 2021/113772 | A1 | 6/2021 |
| WO | WO 2021/138469 | A1 | 7/2021 |
| WO | WO 2021/142343 | A1 | 7/2021 |
| WO | WO 2021/155065 | A1 | 8/2021 |
| WO | WO 2021/158921 | A2 | 8/2021 |
| WO | WO 2021/158995 | A1 | 8/2021 |
| WO | WO 2021/158999 | A1 | 8/2021 |
| WO | WO 2021/178709 | A1 | 9/2021 |
| WO | WO 2021/178717 | A2 | 9/2021 |
| WO | WO 2021/178720 | A2 | 9/2021 |
| WO | WO 2021/178898 | A1 | 9/2021 |
| WO | WO 2021/183761 | A1 | 9/2021 |
| WO | WO 2021/183961 | A1 | 9/2021 |
| WO | WO 2021/188996 | A1 | 9/2021 |
| WO | WO 2021/220020 | A1 | 11/2021 |
| WO | WO 2021/222318 | A1 | 11/2021 |
| WO | WO 2021/226558 | A1 | 11/2021 |
| WO | WO 2021/231505 | A1 | 11/2021 |
| WO | WO 2021/233975 | A1 | 11/2021 |
| WO | WO 2021/252924 | A1 | 12/2021 |
| WO | WO 2022/008510 | A2 | 1/2022 |
| WO | WO 2022/013872 | A1 | 1/2022 |
| WO | WO 2022/051250 | A1 | 3/2022 |
| WO | WO 2022/056254 | A2 | 3/2022 |

(56) References Cited

FOREIGN PATENT DOCUMENTS

| | | | |
|---|---|---|---|
| WO | WO 2022/067130 | A2 | 3/2022 |
| WO | WO 2022/075813 | A1 | 4/2022 |
| WO | WO 2022/075816 | A1 | 4/2022 |
| WO | WO 2022/150790 | A2 | 7/2022 |
| WO | WO 2022/165262 | A1 | 8/2022 |
| WO | WO 2023/015309 | A2 | 2/2023 |
| WO | WO 2023/102537 | A2 | 6/2023 |
| WO | WO 2023/102538 | A1 | 6/2023 |
| WO | WO 2023/102550 | A2 | 6/2023 |
| WO | WO 2023/173140 | A2 | 9/2023 |
| WO | WO 2024/155741 | A1 | 7/2024 |
| WO | WO 2024/155745 | A1 | 7/2024 |
| WO | WO 2024/215652 | A2 | 10/2024 |
| WO | WO 2024/254346 | A1 | 12/2024 |

OTHER PUBLICATIONS

Gaudelli et al., 2017, Nature, vol. 551, pp. 464-487 (Year: 2017).*

GenCore., 2025, Sequence Alignment of '841 Espacenet MT SEQ ID No. 6 positions 199-364 vs. wildtype *E. coli* TadA NCBI accession code P68398, pp. 1. (Year: 2025).*

GenCore., 2025, Sequence Alignment of '841 Espacenet MT SEQ ID No. 6 positions 397-562 vs. Instant SEQ ID No. 86 (Year: 2025).*

CN109517841 Espacenet Machine Translation Description, pp. 1-20 (Year: 2019).*

[No Author Listed] NCBI Reference Sequence: WP_032188360.1. Apr. 6, 2015. 1 page.

[No Author Listed], "Lambda DNA" from Catalog & Technical Reference. New England Biolabs Inc. 2002/2003. pp. 133 and 270-273.

[No Author Listed], Adenine deaminase polypeptide SEQ: 49. EBI Acc. No. BJG44493. Jun. 10, 2021. 1 page.

[No Author Listed], CMP/dCMP-type deaminase domain-containing protein. Uniprot Accession No. A0A2Z6RZE9. Oct. 10, 2018. Accessible at https://www.uniprot.org/uniprotkb/A0A2Z6RZE9/entry. 8 pages.

[No Author Listed], dCas9-5xPlat2AfID-P2A-scFvGCN4sfGFPTET1CD [Cloning vector pPlatTET-gRNA2]. GenBank No. BAV54124. Apr. 18, 2017. 5 pages.

[No Author Listed], Gag-Pol polyprotein. UniProtKB/Swiss-Prot No. P03355.5. Sep. 18, 2019. 18 pages.

[No Author Listed], *Homo sapiens* signal transducer and activator of transcription 3 (STAT3), transcript variant 1, mRNA. NCBI Ref Seq No. NM_139276.2. Retrived from https://www.ncbi.nlm.nih.gov/nuccore/nm_139276.2. Feb. 26, 2020. 8 pages.

[No Author Listed], Multispecies: tRNA adenosine(34) deaminase TadA [Enterobacteriaceae]. NCBI Ref Seq No. WP_001297409.1. Feb. 28, 2022. Retrieved from https://www.ncbi.nlm.nih.gov/protein/WP_001297409.1/. 2 pages.

[No Author Listed], MutL homolog 1. UniProtKB Acc. No. F1MPG0. May 3, 2011. Accessible at https://rest.uniprot.org/unisave/F1MPG0?format=txt&versions=1. 1 page.

[No Author Listed], *Streptococcus pyogenes* Cas9 protein. EBI Acc. No. BIR16744. Jan. 2, 20211. 1 page.

[No Author Listed], *Streptococcus pyogenes* Cas9 protein. EBI Acc. No. BIR16747. Jan. 21, 2021. 1 page.

[No Author Listed], tRNA-specific adenosine deaminase [Candidatus Moranella endobia PCVAL]. GenBank Acc. No. AGJ61179.1. Accessible at https://www.ncbi.nlm.nih.gov/protein/AGJ61179. Jan. 30, 2014. 3 pages.

[No Author Listed], tRNA-specific adenosine deaminase [*Escherichia coli*]. GenBank Acc. No. CTS26096.1. Accessible at https://www.ncbi.nlm.nih.gov/protein/CTS26096.1. Aug. 22, 2015. 1 page.

[No Author Listed], tRNA-specific adenosine deaminase 2 [Terrapene triunguis]. GenBank Acc. No. XP_024075810.1. Accessible at https://www.ncbi.nlm.nih.gov/protein/XP_024075810. Jul. 15, 2019. 2 pages.

[No Author Listed], tRNA-specific adenosine deaminase TAD2 isoform X2 [Panicum hallii]. GenBank Acc. No. XP_025793740.1. Accessible at https://www.ncbi.nlm.nih.gov/protein/025793740. Jul. 27, 2018. 1 page.

[No Author Listed], tRNA-specific adenosine deaminase TAD2 isoform X1 [Oryza sativa Japonica Group]. GenBank Acc. No. XP_15631651.1. Accessible at https://www.ncbi.nlm.nih.gov/protein/1002254769?sat=58&satkey=133677684. Aug. 7, 2018. 2 pages.

[No Author Listed], tRNA-specific adenosine deaminase. Uniprot Accession No. A0A1U7M801. May 10, 2017. Accessible at https://www.uniprot.org/uniprotkb/A0A1U7M801/history. 3 pages.

[No Author Listed], tRNA-specific adenosine deaminase. Uniprot Accession No. A0A1Z4VPW4. Sep. 27, 2017. Accessible at https://www.uniprot.org/uniprotkb/A0A1Z4VPW4/history. 3 pages.

[No Author Listed], tRNA-specific adenosine deaminase. Uniprot Accession No. A0A1Z9LY19. Oct. 25, 2017. Accessible at https://www.uniprot.org/uniprotkb/A0A1Z9LY19/entry. 12 pages.

[No Author Listed], tRNA-specific adenosine deaminase. Uniprot Accession No. A0A2P5TOZ9. May 23, 2018. Accessible at https://www.uniprot.org/uniprotkb/A0A2P5T0Z9/entry. 10 pages.

[No Author Listed], tRNA-specific adenosine deaminase. Uniprot Accession No. A0A4P6PH16. Jul. 31, 2019. Accessible at https://www.uniprot.org/uniprotkb/A0A4P6PH16/entry. 12 pages.

[No Author Listed], tRNA-specific adenosine deaminase. Uniprot Accession No. A0A520SVM3. Oct. 16, 2019. Accessible at https://www.uniprot.org/uniprotkb/A0A520SVM3/entry. 10 pages.

[No Author Listed], tRNA-specific adenosine deaminase. Uniprot Accession No. U2JUU0. Nov. 13, 2013. Accessible at https://www.uniprot.org/uniprotkb/U2JUU0/entry. 11 pages.

Acharya et al., hMSH2 forms specific mispair-binding complexes with hMSH3 and hMSH6. Proc Natl Acad Sci U S A. Nov. 26, 1996;93(24):13629-34. doi: 10.1073/pnas.93.24.13629.

Ai et al., C-terminal Loop Mutations Determine Folding and Secretion Properties of PCSK9. iMedPub J: Biochem Mol Biol J. Nov. 5, 2016;2(3):17. doi: 10.21767/2471-8084.100026. 12 pages.

Alizadeh et al., HR9: An Important Cell Penetrating Peptide for Delivery of HCV NS3 DNA into HEK-293T Cells. Avicenna J Med Biotechnol. Jan.-Mar. 2020;12(1):44-51.

Alves et al., Immunogenicity of the carcinoembryonic antigen derived peptide 694 in HLA-A2 healthy donors and colorectal carcinoma patients. Cancer Immunol Immunother. Nov. 2007;56(11):1795-805. doi: 10.1007/s00262-007-0323-2. Epub Apr. 20, 2007.

Anzalone et al., Search-and-replace genome editing without double-strand breaks or donor DNA. Nature. Dec. 2019;576(7785):149-157 and Suppl Info. doi: 10.1038/s41586-019-1711-4. Epub Oct. 21, 2019. 72 pages.

Asemissen et al., Identification of a highly immunogenic HLA-A*01-binding T cell epitope of WT1. Clin Cancer Res. Dec. 15, 2006;12(24):7476-82. doi: 10.1158/1078-0432.CCR-06-1337.

Attia et al., Autoimmunity correlates with tumor regression in patients with metastatic melanoma treated with anti-cytotoxic T-lymphocyte antigen-4. J Clin Oncol. Sep. 1, 2005;23(25):6043-53. doi: 10.1200/JCO.2005.06.205. Epub Aug. 8, 2005.

Aurisicchio et al., A novel minigene scaffold for therapeutic cancer vaccines. Oncoimmunology. Jan. 1, 2014;3(1):e27529. doi: 10.4161/onci.27529. Epub Jan. 16, 2014.

Avidan et al., Expression and characterization of a recombinant novel reverse transcriptase of a porcine endogenous retrovirus. Virology. Mar. 15, 2003;307(2):341-57. doi: 10.1016/s0042-6822(02)00131-9.

Azzam et al., FTO m6A Demethylase in Obesity and Cancer: Implications and Underlying Molecular Mechanisms. Int J Mol Sci. Mar. 30, 2022;23(7):3800. doi: 10.3390/ijms23073800.

Baba et al., Construction of *Escherichia coli* K-12 in-frame, single-gene knockout mutants: the Keio collection. Mol Syst Biol. 2006;2:2006.0008. doi: 10.1038/msb4100050. Epub Feb. 21, 2006.

Bae et al., Heteroclitic CD33 peptide with enhanced anti-acute myeloid leukemic immunogenicity. Clin Cancer Res. Oct. 15, 2004;10(20):7043-52. doi: 10.1158/1078-0432.CCR-04-0322.

(56) References Cited

OTHER PUBLICATIONS

Bae et al., Identification of novel CD33 antigen-specific peptides for the generation of cytotoxic T lymphocytes against acute myeloid leukemia. Cell Immunol. Jan. 2004;227(1):38-50. doi: 10.1016/j.cellimm.2004.01.002.
Bakker et al., Analogues of CTL epitopes with improved MHC class-I binding capacity elicit anti-melanoma CTL recognizing the wild-type epitope. Int J Cancer. Jan. 27, 1997;70(3):302-9. doi: 10.1002/(sici)1097-0215(19970127)70:3<302::aid-ijc10>3.0.co;2-h.
Banerjee et al., Viral glycoproteins: biological role and application in diagnosis. Virusdisease. Mar. 2016;27(1):1-11. doi: 10.1007/s13337-015-0293-5. Epub Jan. 18, 2016.
Baños-Sanz et al., Crystal structure and functional insights into uracil-DNA glycosylase inhibition by phage Φ29 DNA mimic protein p56. Nucleic Acids Res. Jul. 2013;41(13):6761-73. doi: 10.1093/nar/gkt395. Epub May 13, 2013.
Banskota et al., Engineered virus-like particles for efficient in vivo delivery of therapeutic proteins. Cell. Jan. 20, 2022;185(2):250-265.e16. doi: 10.1016/j.cell.2021.12.021. Epub Jan. 11, 2022.
Barve et al., Induction of immune responses and clinical efficacy in a phase II trial of IDM-2101, a 10-epitope cytotoxic T-lymphocyte vaccine, in metastatic non-small-cell lung cancer. J Clin Oncol. Sep. 20, 2008;26(27):4418-25. doi: 10.1200/JCO.2008.16.6462.
Basila et al., Minimal 2'-O-methyl phosphorothioate linkage modification pattern of synthetic guide RNAs for increased stability and efficient CRISPR-Cas9 gene editing avoiding cellular toxicity. PLoS One. Nov. 27, 2017;12(11):e0188593. doi: 10.1371/journal.pone.0188593.
Benlalam et al., Identification of five new HLA-B*3501-restricted epitopes derived from common melanoma-associated antigens, spontaneously recognized by tumor-infiltrating lymphocytes. J Immunol. Dec. 1, 2003;171(11):6283-9. doi: 10.4049/jimmunol.171.11.6283.
Bernatchez et al., Altered decamer and nonamer from an HLA-A0201-restricted epitope of Survivin differentially stimulate T-cell responses in different individuals. Vaccine. Apr. 5, 2011;29(16):3021-30. doi: 10.1016/j.vaccine.2011.01.115. Epub Feb. 12, 2011.
Bertsimas et al., Simulated annealing. Statistical Science. Feb. 1993;8(1):10-15. doi: 10.1214/ss/1177011077.
Bibikova et al., Targeted chromosomal cleavage and mutagenesis in *Drosophila* using zinc-finger nucleases. Genetics. Jul. 2002;161(3):1169-75. doi: 10.1093/genetics/161.3.1169.
Bioley et al., Melan-A/MART-1-specific CD4 T cells in melanoma patients: identification of new epitopes and ex vivo visualization of specific T cells by MHC class II tetramers. J Immunol. Nov. 15, 2006;177(10):6769-79. doi: 10.4049/jimmunol.177.10.6769.
Blanchet et al., A new generation of Melan-A/MART-1 peptides that fulfill both increased immunogenicity and high resistance to biodegradation: implication for molecular anti-melanoma immunotherapy. J Immunol. Nov. 15, 2001;167(10):5852-61. doi: 10.4049/jimmunol.167.10.5852.
Blauw et al., SMN1 gene duplications are associated with sporadic ALS. Neurology. Mar. 13, 2012;78(11):776-80. doi: 10.1212/WNL.0b013e318249f697. Epub Feb. 8, 2012.
Borbulevych et al., Increased immunogenicity of an anchor-modified tumor-associated antigen is due to the enhanced stability of the peptide/MHC complex: implications for vaccine design. J Immunol. Apr. 15, 2005;174(8):4812-20. doi: 10.4049/jimmunol.174.8.4812.
Bosch et al., Precise genome engineering in *Drosophila* using prime editing. Proc Natl Acad Sci U S A. Jan. 5, 2021;118(1):e2021996118. doi: 10.1073/pnas.2021996118.
Brichard et al., A tyrosinase nonapeptide presented by HLA-B44 is recognized on a human melanoma by autologous cytolytic T lymphocytes. Eur J Immunol. Jan. 1996;26(1):224-30. doi: 10.1002/eji.1830260135.
Brutlag et al., Improved sensitivity of biological sequence database searches. Comput Appl Biosci. Jul. 1990;6(3):237-45. doi: 10.1093/bioinformatics/6.3.237.
Bulcha et al., Viral vector platforms within the gene therapy landscape. Signal Transduct Target Ther. Feb. 8, 2021;6(1):53. doi: 10.1038/s41392-021-00487-6.
Cacabelos et al., Chapter 1—The Epigenetic Machinery in the Life Cycle and Pharmacoepigenetics. Pharmacoepigenetics. vol. 10 in Translational Epigenetics. 2019:1-100. doi: https://doi.org/10.1016/B978-0-12-813939-4.00001-2. 7 pages.
Campbell et al., Gesicle-Mediated Delivery of CRISPR/Cas9 Ribonucleoprotein Complex for Inactivating the HIV Provirus. Mol Ther. Jan. 2, 2019;27(1):151-163. doi: 10.1016/j.ymthe.2018.10.002. Epub Oct. 11, 2018.
Campi et al., CD4(+) T cells from healthy subjects and colon cancer patients recognize a carcinoembryonic antigen-specific immunodominant epitope. Cancer Res. Dec. 1, 2003;63(23):8481-6.
Carlier et al., Genome Sequence of Burkholderia cenocepacia H111, a Cystic Fibrosis Airway Isolate. Genome Announc. Apr. 10, 2014;2(2):e00298-14. doi: 10.1128/genomeA.00298-14.
Cartegni et al., Determinants of exon 7 splicing in the spinal muscular atrophy genes, SMN1 and SMN2. Am J Hum Genet. Jan. 2006;78(1):63-77. doi: 10.1086/498853. Epub Nov. 16, 2005.
Casnici et al., Immunologic evaluation of peptides derived from BCR/ABL-out-of-frame fusion protein in HLA A2.1 transgenic mice. J Immunother. May 2012;35(4):321-8. doi: 10.1097/CJI.0b013e3182562d37.
Casnici et al., Out of frame peptides from BCR/ABL alternative splicing are immunogenic in HLA A2.1 transgenic mice. Cancer Lett. Apr. 8, 2009;276(1):61-7. doi: 10.1016/j.canlet.2008.10.032. Epub Dec. 4, 2008.
Castelli et al., Mass spectrometric identification of a naturally processed melanoma peptide recognized by CD8+ cytotoxic T lymphocytes. J Exp Med. Jan. 1, 1995;181(1):363-8. doi: 10.1084/jem.181.1.363.
Castelli et al., Novel HLA-Cw8-restricted T cell epitopes derived from tyrosinase-related protein-2 and gp100 melanoma antigens. J Immunol. Feb. 1, 1999;162(3):1739-48.
Castle et al., Exploiting the mutanome for tumor vaccination. Cancer Res. Mar. 1, 2012;72(5):1081-91. doi: 10.1158/0008-5472.CAN-11-3722. Epub Jan. 11, 2012.
Cervera et al., Generation of HIV-1 Gag VLPs by transient transfection of HEK 293 suspension cell cultures using an optimized animal-derived component free medium. J Biotechnol. Jul. 20, 2013;166(4):152-65. doi: 10.1016/j.jbiotec.2013.05.001. Epub May 17, 2013.
Chang et al., Degradation of survival motor neuron (SMN) protein is mediated via the ubiquitin/proteasome pathway. Neurochem Int. Dec. 2004;45(7):1107-12. doi: 10.1016/j.neuint.2004.04.005.
Chao et al., Measurement of large serine integrase enzymatic characteristics in HEK293 cells reveals variability and influence on downstream reporter expression. FEBS J. Nov. 2021;288(22):6410-6427. doi: 10.1111/febs.16037. Epub Jun. 23, 2021.
Chatterjee et al., A Cas9 with PAM recognition for adenine dinucleotides. Nat Commun. May 18, 2020;11(1):2474. doi: 10.1038/s41467-020-16117-8.
Chatterjee et al., Robust Genome Editing of Single-Base PAM Targets; with Engineered ScCas9 Variants. bioRxiv. doi: 10.1101/620351. Posted Apr. 26, 2019.
Chen et al., Dynamic imaging of genomic loci in living human cells by an optimized CRISPR/Cas system. Cell. Dec. 19, 2013;155(7):1479-91. doi: 10.1016/j.cell.2013.12.001. Erratum in: Cell. Jan. 16, 2014;156(1-2):373.
Chen et al., Identification of NY-ESO-1 peptide analogues capable of improved stimulation of tumor-reactive CTL. J Immunol. Jul. 15, 2000;165(2):948-55. doi: 10.4049/jimmunol.165.2.948.
Chen et al., Programmable C:G to G:C genome editing with CRISPR-Cas9-directed base excision repair proteins. Nat Commun. Mar. 2, 2021;12(1):1384. doi: 10.1038/s41467-021-21559-9.
Cheng et al., [Cloning,expression and activity identification of human innate immune protein apolipoprotein B mRNA editing enzyme catalytic subunit 3A(APOBEC3A)]. Xi Bao Yu Fen Zi Mian Yi Xue Za Zhi. Chinese Journal of Cellular and Molecular Immunology, Feb. 2017;33(2):179-84. Chinese.

(56) References Cited

OTHER PUBLICATIONS

Cheriyan et al., Faster protein splicing with the Nostoc punctiforme DnaE intein using non-native extein residues. J Biol Chem. Mar. 1, 2013;288(9):6202-11. doi: 10.1074/jbc.M112.433094. Epub Jan. 10, 2013.
Cho et al., A degron created by SMN2 exon 7 skipping is a principal contributor to spinal muscular atrophy severity. Genes Dev. Mar. 1, 2010;24(5):438-42. doi: 10.1101/gad.1884910.
Cho et al., Optimized peptide vaccines eliciting extensive CD8 T-cell responses with therapeutic antitumor effects. Cancer Res. Dec. 1, 2009;69(23):9012-9. doi: 10.1158/0008-5472.CAN-09-2019. Epub Nov. 10, 2009.
Choi et al., Lentivirus pre-packed with Cas9 protein for safer gene editing. Gene Ther. Jul. 2016;23(7):627-33. doi: 10.1038/gt.2016.27. Epub Apr. 7, 2016.
Choi et al., Optimization of AAV expression cassettes to improve packaging capacity and transgene expression in neurons. Mol Brain. Mar. 11, 2014;7:17. doi: 10.1186/1756-6606-7-17.
Christensen et al., Melan-A/MART1 analog peptide triggers anti-myeloma T-cells through crossreactivity with HM1.24. J Immunother. Jul.-Aug. 2009;32(6):613-21. doi: 10.1097/CJI.0b013e3181a95198.
Corcia et al., The importance of the SMN genes in the genetics of sporadic ALS. Amyotroph Lateral Scler. Oct.-Dec. 2009;10(5-6):436-40. doi: 10.3109/17482960902759162.
Correale et al., In vitro generation of human cytotoxic T lymphocytes specific for peptides derived from prostate-specific antigen. J Natl Cancer Inst. Feb. 19, 1997;89(4):293-300. doi: 10.1093/jnci/89.4.293.
Corti et al., Genetic correction of human induced pluripotent stem cells from patients with spinal muscular atrophy. Sci Transl Med. Dec. 19, 2012;4(165):165ra162. doi: 10.1126/scitranslmed.3004108.
Courtney et al., CRISPR/Cas9 DNA cleavage at SNP-derived PAM enables both in vitro and in vivo KRT12 mutation-specific targeting. Gene Ther. Jan. 2016;23(1):108-12. doi: 10.1038/gt.2015.82. Epub Aug. 20, 2015.
Cox et al., Identification of a peptide recognized by five melanoma-specific human cytotoxic T cell lines. Science. Apr. 29, 1994;264(5159):716-9. doi: 10.1126/science.7513441.
Cronin et al., Altering the tropism of lentiviral vectors through pseudotyping. Curr Gene Ther. Aug. 2005;5(4):387-98. doi: 10.2174/1566523054546224. Erratum in: Curr Gene Ther. Oct. 2005;5(5):531. Author Manuscript, 19 pages.
Crosti et al., Identification of novel subdominant epitopes on the carcinoembryonic antigen recognized by CD4+ T cells of lung cancer patients. J Immunol. Apr. 15, 2006;176(8):5093-9. doi: 10.4049/jimmunol.176.8.5093.
Cucchiarini et al., Enhanced expression of the central survival of motor neuron (SMN) protein during the pathogenesis of osteoarthritis. J Cell Mol Med. Jan. 2014;18(1):115-24. doi: 10.1111/jcmm.12170. Epub Nov. 17, 2013.
Dalet et al., An antigenic peptide produced by reverse splicing and double asparagine deamidation. Proc Natl Acad Sci U S A. Jul. 19, 2011;108(29):E323-31. doi: 10.1073/pnas.1101892108. Epub Jun. 13, 2011.
Damdindorj et al., A comparative analysis of constitutive promoters located in adeno-associated viral vectors. PLoS One. Aug. 29, 2014;9(8):e106472. doi: 10.1371/journal.pone.0106472.
David et al., Viral Vectors: The Road to Reducing Genotoxicity. Toxicol Sci. Feb. 2017;155(2):315-325. doi: 10.1093/toxsci/kfw220. Epub Nov. 1, 2016.
Depontieu et al., Identification of tumor-associated, MHC class II-restricted phosphopeptides as targets for immunotherapy. Proc Natl Acad Sci U S A. Jul. 21, 2009;106(29):12073-8. doi: 10.1073/pnas.0903852106. Epub Jul. 6, 2009.
Di Stasi et al., Review of the Results of WT1 Peptide Vaccination Strategies for Myelodysplastic Syndromes and Acute Myeloid Leukemia from Nine Different Studies. Front Immunol. Feb. 4, 2015;6:36. doi: 10.3389/fimmu.2015.00036.
Dickinson et al., A system for the continuous directed evolution of proteases rapidly reveals drug-resistance mutations. Nat Commun. Oct. 30, 2014;5:5352. doi: 10.1038/ncomms6352.
Ding et al., Gene therapy for cardiovascular disease. Journal of Shanghai University (Natural Science Edition) . 2016;3:270-9 . DOI: 10.3969/j.issn.1007-2861.2016.03.013.
Drenth et al., Mutations in sodium-channel gene SCN9A cause a spectrum of human genetic pain disorders. J Clin Invest. Dec. 2007;117(12):3603-9. doi: 10.1172/JCI33297.
Duan et al., Immune rejection of mouse tumors expressing mutated self. Cancer Res. Apr. 15, 2009;69(8):3545-53. doi: 10.1158/0008-5472.CAN-08-2779. Epub Apr. 7, 2009. Author Manuscript. 18 pages.
Dugar et al., CRISPR RNA-Dependent Binding and Cleavage of Endogenous RNAs by the Campylobacter jejuni Cas9. Mol Cell. Mar. 1, 2018;69(5):893-905.e7. doi: 10.1016/j.molcel.2018.01.032.
Duportet et al., A platform for rapid prototyping of synthetic gene networks in mammalian cells. Nucleic Acids Res. Dec. 1, 2014;42(21):13440-51. doi: 10.1093/nar/gku1082. Epub Nov. 5, 2014.
D'Ydewalle et al., The Antisense Transcript SMN-AS1 Regulates SMN Expression and Is a Novel Therapeutic Target for Spinal Muscular Atrophy. Neuron. Jan. 4, 2017;93(1):66-79 and Supplemental Information. doi: 10.1016/j.neuron.2016.11.033. Epub Dec. 22, 2016.
Edraki et al., A Compact, High-Accuracy Cas9 with a Dinucleotide PAM for In Vivo Genome Editing. Mol Cell. Feb. 21, 2019;73(4):714-726.e4 and Supplemental Info. doi: 10.1016/j.molcel.2018.12.003. Epub Dec. 20, 2018.
Ekman et al., CRISPR-Cas9-Mediated Genome Editing Increases Lifespan and Improves Motor Deficits in a Huntington's Disease Mouse Model. Mol Ther Nucleic Acids. Sep. 6, 2019;17:829-839. doi: 10.1016/j.omtn.2019.07.009. Epub Jul. 26, 2019.
Ekstrand et al., Frequent alterations of the PI3K/AKT/mTOR pathways in hereditary nonpolyposis colorectal cancer. Fam Cancer. Jun. 2010;9(2):125-9. doi: 10.1007/s10689-009-9293-1.
Entin-Meer et al., The role of phenylalanine-119 of the reverse transcriptase of mouse mammary tumour virus in DNA synthesis, ribose selection and drug resistance. Biochem J. Oct. 15, 20025;367(Pt 2):381-91. doi: 10.1042/BJ20020712.
Eriksen et al., Occlusion of the Ribosome Binding Site Connects the Translational Initiation Frequency, mRNA Stability and Premature Transcription Termination. Front Microbiol. Mar. 14, 2017;8:362. doi: 10.3389/fmicb.2017.00362.
Fang et al., Human strand-specific mismatch repair occurs by a bidirectional mechanism similar to that of the bacterial reaction. J Biol Chem. Jun. 5, 1993;268(16):11838-44.
Fang et al., The Menu of Features that Define Primary MicroRNAs and Enable De Novo Design of MicroRNA Genes. Mol Cell. Oct. 1, 2015;60(1):131-45. doi: 10.1016/j.molcel.2015.08.015. Epub Sep. 24, 2015.
Feng et al., Efficient genome editing in plants using a CRISPR/Cas system. Cell Res. Oct. 2013;23(10):1229-32. doi: 10.1038/cr.2013.114. Epub Aug. 20, 2013.
Fields et al., Gene targeting techniques for Huntington's disease. Ageing Res Rev. Sep. 2021;70:101385. doi: 10.1016/j.arr.2021.101385. Epub Jun. 5, 2021.
Fikes et al., Design of multi-epitope, analogue-based cancer vaccines. Expert Opin Biol Ther. Sep. 2003;3(6):985-93. doi: 10.1517/14712598.3.6.985.
Fishel et al., The human mutator gene homolog MSH2 and its association with hereditary nonpolyposis colon cancer. Cell. Dec. 3, 1993;75(5):1027-38. doi: 10.1016/0092-8674(93)90546-3. Erratum in: Cell. Apr. 8, 1994;77(1):1 p following 166.
Fontana et al., Rabies virus-like particles expressed in HEK293 cells. Vaccine. May 19, 2014;32(24):2799-804. doi: 10.1016/j.vaccine.2014.02.031. Epub Mar. 12, 2014.
Fonteneau et al., The Tumor Antigen NY-ESO-1 Mediates Direct Recognition of Melanoma Cells by CD4+ T Cells after Intercellular Antigen Transfer. J Immunol. Jan. 1, 2016;196(1):64-71. doi: 10.4049/jimmunol.1402664. Epub Nov. 25, 2015.
Fourcade et al., PD-1 and Tim-3 regulate the expansion of tumor antigen-specific CD8? T cells induced by melanoma vaccines.

(56) References Cited

OTHER PUBLICATIONS

Cancer Res. Feb. 15, 2014;74(4):1045-55. doi: 10.1158/0008-5472.CAN-13-2908. Epub Dec. 16, 2013.
Fridman et al., An efficient T-cell epitope discovery strategy using in silico prediction and the iTopia assay platform. Oncoimmunology. Nov. 1, 2012;1(8):1258-1270. doi: 10.4161/onci.21355.
Friedman, J. H., Greedy function approximation: A gradient boosting machine. Ann. Statist. Oct. 2001;29(5):1189-232. doi: 10.1214/aos/1013203451.
Fu et al., Targeted genome editing in human cells using CRISPR/Cas nucleases and truncated guide RNAs. Methods Enzymol. 2014;546:21-45. doi: 10.1016/B978-0-12-801185-0.00002-7.
Fujiki et al., Identification and characterization of a WT1 (Wilms Tumor Gene) protein-derived HLA-DRB1*0405-restricted 16-mer helper peptide that promotes the induction and activation of WT1-specific cytotoxic T lymphocytes. J Immunother. Apr. 2007;30(3):282-93. doi: 10.1097/01.cji.0000211337.91513.94.
Gaudelli et al., Directed evolution of adenine base editors with increased activity and therapeutic application. Nat Biotechnol. Jul. 2020;38(7):892-900. doi: 10.1038/s41587-020-0491-6. Epub Apr. 13, 2020.
Gee et al., Extracellular nanovesicles for packaging of CRISPR-Cas9 protein and sgRNA to induce therapeutic exon skipping. Nat Commun. Mar. 13, 2020;11(1):1334. doi: 10.1038/s41467-020-14957-y.
Geisberg et al., Global analysis of mRNA isoform half-lives reveals stabilizing and destabilizing elements in yeast. Cell. Feb. 13, 2014;156(4):812-24. doi: 10.1016/j.cell.2013.12.026.
GenBank Access No. BAP64357. Aug. 1, 2013. 1 page.
GenBank Submission; NIH/NCBI, Accession No. NC_000001.11. Gregory et al., Jun. 6, 2016. 3 pages.
GenBank Submission; NIH/NCBI, Accession No. NM_206933.2. Khalaileh et al., Sep. 16, 2018. 12 pages.
GenBank Submission; NIH/NCBI, Accession No. NP_060228.2. Bi et al., Dec. 21, 2005. 1 page.
GenBank Submission; NIH/NCBI, Accession No. NP_062826.2. Bokar et al., Sep. 18, 2004. 2 pages.
GenBank Submission; NIH/NCBI, Accession No. NP_066012.1. Ota et al., Apr. 3, 2005. 2 pages.
GenBank Submission; NIH/NCBI, Accession No. NP_996816.2. Fu et al., Sep. 22, 2019. 9 pages.
GenBank Submission; NIH/NCBI, Accession No. WP_042518169.1. No Author, Feb. 10, 2015. 1 page.
Geng et al., In vitro studies of DNA mismatch repair proteins. Anal Biochem. Jun. 15, 2011;413(2):179-84. doi: 10.1016/j.ab.2011.02.017. Epub Feb. 15, 2011.
Genschel et al., Human exonuclease I is required for 5' and 3' mismatch repair. J Biol Chem. Apr. 12, 2002;277(15):13302-11. doi: 10.1074/jbc.M111854200. Epub Jan. 24, 2002.
Genschel et al., Isolation of MutSbeta from human cells and comparison of the mismatch repair specificities of MutSbeta and MutSalpha. J Biol Chem. Jul. 31, 1998;273(31):19895-901. doi: 10.1074/jbc.273.31.19895. Erratum in: J Biol Chem Oct. 9, 1998;273(41):27034.
Geynisman et al., A randomized pilot phase I study of modified carcinoembryonic antigen (CEA) peptide (CAP1-6D)/montanide/GM-CSF-vaccine in patients with pancreatic adenocarcinoma. J Immunother Cancer. Jun. 27, 2013;1:8. doi: 10.1186/2051-1426-1-8.
Ghosh et al., Synapsis in phage Bxb1 integration: selection mechanism for the correct pair of recombination sites. J Mol Biol. Jun. 3, 2005;349(2):331-48. doi: 10.1016/j.jmb.2005.03.043. Epub Apr. 7, 2005.
Girard-Gagnepain et al., Baboon envelope pseudotyped LVs outperform VSV-G-LVs for gene transfer into early-cytokine-stimulated and resting HSCs. Blood. Aug. 21, 2014;124(8):1221-31. doi: 10.1182/blood-2014-02-558163. Epub Jun. 20, 2014.
Godefroy et al., Identification of two Melan-A CD4+ T cell epitopes presented by frequently expressed MHC class II alleles. Clin Immunol. Oct. 2006;121(1):54-62. doi: 10.1016/j.clim.2006.05.007. Epub Jun. 30, 2006.
Graff-Dubois et al., Generation of CTL recognizing an HLA-A*0201-restricted epitope shared by MAGE-A1, -A2, -A3, -A4, -A6, -A10, and -A12 tumor antigens: implication in a broad-spectrum tumor immunotherapy. J Immunol. Jul. 1, 2002;169(1):575-80. doi: 10.4049/jimmunol.169.1.575.
Grati et al., Localization of PDZD7 to the stereocilia ankle-link associates this scaffolding protein with the Usher syndrome protein network. J Neurosci. Oct. 10, 2012;32(41):14288-93. doi: 10.1523/JNEUROSCI.3071-12.2012.
Green et al., Characterization of the mechanical unfolding of RNA pseudoknots. J Mol Biol. Jan. 11, 2008;375(2):511-28. doi: 10.1016/j.jmb.2007.05.058. Epub May 26, 2007.
Gross et al., High vaccination efficiency of low-affinity epitopes in antitumor immunotherapy. J Clin Invest. Feb. 2004;113(3):425-33. doi: 10.1172/JCI19418.
Gueneau et al., Structure of the MutLa C-terminal domain reveals how Mlh1 contributes to Pms1 endonuclease site. Nat Struct Mol Biol. Apr. 2013;20(4):461-8. doi: 10.1038/nsmb.2511. Epub Feb. 24, 2013.
Guerrette et al., The interaction of the human MutL homologues in hereditary nonpolyposis colon cancer. J Biol Chem. Mar. 5, 1999;274(10):6336-41. doi: 10.1074/jbc.274.10.6336.
Guevara-Patiño et al., Optimization of a self antigen for presentation of multiple epitopes in cancer immunity. J Clin Invest. May 2006;116(5):1382-90. doi: 10.1172/JCI25591. Epub Apr. 13, 2006.
Guibinga et al., Cell surface heparan sulfate is a receptor for attachment of envelope protein-free retrovirus-like particles and VSV-G pseudotyped MLV-derived retrovirus vectors to target cells. Mol Ther. May 2002;5(5 Pt 1):538-46. doi: 10.1006/mthe.2002.0578.
Gulley et al., Combining a Recombinant Cancer Vaccine with Standard Definitive Radiotherapy in Patients with Localized Prostate Cancer. Clin Cancer Res. May 2, 2005;11(9):3353-62. doi: 10.1158/1078-0432.CCR-4-2062.
Guo et al., Direct recognition and lysis of leukemia cells by WT1-specific CD4+ T lymphocytes in an HLA class II-restricted manner. Blood. Aug. 15, 2005;106(4): 1415-8. doi: 10.1182/blood-2005-01-0413. Epub Apr. 21, 2005.
Guo et al., Precision modeling of mitochondrial diseases in zebrafish via DdCBE-mediated mtDNA base editing. Cell Discov. Sep. 3, 2021;7(1):78. doi: 10.1038/s41421-021-00307-9.
Gupta et al., Mechanism of mismatch recognition revealed by human MutSß bound to unpaired DNA loops. Nat Struct Mol Biol. Dec. 18, 2011;19(1):72-8. doi: 10.1038/nsmb.2175.
Gutkin et al., RNA delivery with a human virus-like particle. Nat Biotechnol. Dec. 2021;39(12):1514-1515. doi: 10.1038/s41587-021-01124-x.
Haeussler et al., Genome Editing with CRISPR-Cas9: Can It Get Any Better? J Genet Genomics. May 20, 2016;43(5):239-50. doi: 10.1016/j.jgg.2016.04.008. Epub Apr. 24, 2016. Author Manuscript. 22 pages.
Hagen et al., A high rate of polymerization during synthesis of mouse mammary tumor virus DNA alleviates hypermutation by APOBEC3 proteins. PLoS Pathog. Feb. 15, 2019;15(2):e1007533. doi: 10.1371/journal.ppat.1007533.
Hamilton et al., Targeted delivery of CRISPR-Cas9 and transgenes enables complex immune cell engineering. Cell Rep. Jun. 1, 2021;35(9):109207 and Suppl Info. doi: 10.1016/j.celrep.2021.109207.
Hamilton et al., Targeted delivery of CRISPR-Cas9 and transgenes enables complex immune cell engineering. Cell Rep. Jun. 1, 2021;35(9):109207. doi: 10.1016/j.celrep.2021.109207.
Hänsel-Hertsch et al., DNA G-quadruplexes in the human genome: detection, functions and therapeutic potential. Nat Rev Mol Cell Biol. May 2017;18(5):279-284. doi: 10.1038/nrm.2017.3. Epub Feb. 22, 2017.
Harrington et al., Programmed DNA destruction by miniature CRISPR-Cas14 enzymes. Science. Nov. 16, 2018;362(6416):839-842. doi: 10.1126/science.aav4294. Epub Oct. 18, 2018.

(56) References Cited

OTHER PUBLICATIONS

Hart et al., High-Resolution CRISPR Screens Reveal Fitness Genes and Genotype-Specific Cancer Liabilities. Cell. Dec. 3, 2015;163(6):1515-26. doi: 10.1016/j.cell.2015.11.015. Epub Nov. 25, 2015.
Hawley-Nelson et al., Transfection of Cultured Eukaryotic Cells Using Cationic Lipid Reagents. Curr Prot Mol Biol. Jan. 2008;9.4. 1-9.4.17. doi: 10.102/0471142727.mb0904s81. 17 pages.
Hendel et al., Chemically modified guide RNAs enhance CRISPR-Cas genome editing in human primary cells. Nat Biotechnol. Sep. 2015;33(9):985-989. doi: 10.1038/nbt.3290. Epub Jun. 29, 2015. Author Manuscript. 14 pages.
Herbst-Kralovetz et al., Norwalk virus-like particles as vaccines. Expert Rev Vaccines. Mar. 2010;9(3):299-307. doi: 10.1586/erv.09. 163. Author Manuscript, 16 pages.
Heyer et al., Regulation of homologous recombination in eukaryotes. Annu Rev Genet. 2010;44:113-39. doi: 10.1146/annurev-genet-051710-150955. Author Manuscript. 33 pages.
Hirohashi et al., An HLA-A24-restricted cytotoxic T lymphocyte epitope of a tumor-associated protein, survivin. Clin Cancer Res. Jun. 2002;8(6):1731-9.
Hizi et al., Retroviral reverse transcriptases (other than those of HIV-1 and murine leukemia virus): a comparison of their molecular and biochemical properties. Virus Res. Jun. 2008;134(1-2):203-20. doi: 10.1016/j.virusres.2007.12.008. Epub Mar. 3, 2008.
Hong et al., Novel recombinant hepatitis B virus vectors efficiently deliver protein and RNA encoding genes into primary hepatocytes. J Virol. Jun. 2013;87(12):6615-24. doi: 10.1128/JVI.03328-12. Epub Apr. 3, 2013.
Houck-Loomis et al., An equilibrium-dependent retroviral mRNA switch regulates translational recoding. Nature. Nov. 27, 2011;480(7378):561-4. doi: 10.1038/nature 10657.
Houghton et al., Immunological validation of the EpitOptimizer program for streamlined design of heteroclitic epitopes. Vaccine. Jul. 20, 2007;25(29):5330-42. doi: 10.1016/j.vaccine.2007.05.008. Epub Jun. 4, 2007.
Houseley et al., The many pathways of RNA degradation. Cell. Feb. 20, 2009;136(4):763-76. doi: 10.1016/j.cell.2009.01.019.
Hu et al., Discovery and engineering of small SlugCas9 with broad targeting range and high specificity and activity. Nucleic Acids Res. Apr. 19, 2021;49(7):4008-4019. doi: 10.1093/nar/gkab148.
Huang et al., Gain-of-function mutations in sodium channel Na(v)1.9 in painful neuropathy. Brain. Jun. 2014;137(Pt 6):1627-42. doi: 10.1093/brain/awu079. Epub Apr. 27, 2014.
Humbel et al., Maximizing lentiviral vector gene transfer in the CNS. Gene Ther. Feb. 2021;28(1-2):75-88. doi: 10.1038/s41434-020-0172-6. Epub Jul. 6, 2020. Erratum in: Gene Ther. May 2022;29(5):312.
Hussman et al., Mapping the genetic landscape of DNA double-strand break repair. Cell. Oct. 28, 2021;184(22):5653-5669.e25. doi: 10.1016/j.cell.2021.10.002. Epub Oct. 20, 2021.
Hwang et al., Heritable and precise zebrafish genome editing using a CRISPR-Cas system. PLoS One. Jul. 9, 2013;8(7):e68708. doi: 10.1371/journal.pone.0068708.
Iaccarino et al., hMSH2 and hMSH6 play distinct roles in mismatch binding and contribute differently to the ATPase activity of hMutSalpha. EMBO J. May 1, 1998;17(9):2677-86. doi: 10.1093/emboj/17.9. 2677.
Ibrahim et al., RNA recognition by 3'-to-5' exonucleases: the substrate perspective. Biochim Biophys Acta. Apr. 2008;1779(4):256-65. doi: 10.1016/j.bbagrm.2007.11.004. Epub Dec. 3, 2007.
Indikova et al., Highly efficient 'hit-and-run' genome editing with unconcentrated lentivectors carrying Vpr.Prot.Cas9 protein produced from RRE-containing transcripts. Nucleic Acids Res. Aug. 20, 2020;48(14):8178-8187. doi: 10.1093/nar/gkaa561.
Iyama et al., DNA repair mechanisms in dividing and non-dividing cells. DNA Repair (Amst). Aug. 2013;12(8):620-36. doi: 10.1016/j.dnarep.2013.04.015. Epub May 16, 2013.
Iyer et al., DNA mismatch repair: functions and mechanisms. Chem Rev. Feb. 2006;106(2):302-23. doi: 10.1021/cr0404794.
Jakimo et al., A Cas9 with Complete PAM Recognition for Adenine Dinucleotides. bioRxiv preprint. Sep. 27, 2018. doi.org/10.1101/429654. 29 pages.
Jalaguier et al., Efficient production of HIV-1 virus-like particles from a mammalian expression vector requires the N-terminal capsid domain. PLoS One. 2011;6(11):e28314. doi: 10.1371/journal.pone.0028314. Epub Nov. 30, 2011.
Jaramillo et al., Identification of HLA-A3-restricted CD8+ T cell epitopes derived from mammaglobin-A, a tumor-associated antigen of human breast cancer. Int J Cancer. Dec. 10, 2002;102(5):499-506. doi: 10.1002/ijc.10736.
Jeong et al., Current Status and Challenges of DNA Base Editing Tools. Mol Ther. Sep. 2, 2020;28(9):1938-1952. doi: 10.1016/j.ymthe.2020.07.021. Epub Jul. 23, 2020.
Jiao et al., Random-PE: an efficient integration of random sequences into mammalian genome by prime editing. Mol Biomed. Nov. 18, 2021;2(1):36. doi: 10.1186/s43556-021-00057-w.
Joglekar et al., Pseudotyped Lentiviral Vectors: One Vector, Many Guises. Hum Gene Ther Methods. Dec. 2017;28(6):291-301. doi: 10.1089/hgtb.2017.084. Epub Sep. 4, 2017.
Jost et al., Titrating gene expression using libraries of systematically attenuated CRISPR guide RNAs. Nat Biotechnol. Mar. 2020;38(3):355-364. doi: 10.1038/s41587-019-0387-5. Epub Jan. 13, 2020.
Kaczmarczyk et al., Protein delivery using engineered virus-like particles. Proc Natl Acad Sci U S A. Oct. 11, 2011;108(41):16998-7003. doi: 10.1073/pnas.1101874108. Epub Sep. 26, 2011.
Kadyrov et al., Endonucleolytic function of MutLalpha in human mismatch repair. Cell. Jul. 28, 2006;126(2):297-308. doi: 10.1016/j.cell.2006.05.039.
Kang et al., Chimeric rabies virus-like particles containing membrane-anchored GM-CSF enhances the immune response against rabies virus. Viruses. Mar. 11, 2015;7(3):1134-52. doi: 10.3390/v7031134.
Kang et al., Chloroplast and mitochondrial DNA editing in plants. Nat Plants. Jul. 2021;7(7):899-905. doi: 10.1038/s41477-021-00943-9. Epub Jul. 1, 2021.
Kang et al., Identification of a tyrosinase epitope recognized by HLA-A24-restricted, tumor-infiltrating lymphocytes. J Immunol. Aug. 1, 1995;155(3):1343-8.
Karbach et al., Long-term complete remission following radiosurgery and immunotherapy in a melanoma patient with brain metastasis: immunologic correlates. Cancer Immunol Res. May 2014;2(5):404-9. doi: 10.1158/2326-6066.CIR-13-0200. Epub Feb. 5, 2014.
Karimian et al., CRISPR/Cas9 novel therapeutic road for the treatment of neurodegenerative diseases. Life Sci. Oct. 15, 2020;259:118165. doi: 10.1016/j.lfs.2020.118165. Epub Jul. 29, 2020.
Kato et al., A lentiviral strategy for highly efficient retrograde gene transfer by pseudotyping with fusion envelope glycoprotein. Hum Gene Ther. Feb. 2011;22(2):197-206. doi: 10.1089/hum.2009.179. Epub Jan. 27, 2011.
Kato et al., Selective neural pathway targeting reveals key roles of thalamostriatal projection in the control of visual discrimination. J Neurosci. Nov. 23, 2011;31(47):17169-79. doi: 10.1523/JNEUROSCI.4005-11.2011.
Kawakami et al., Identification of a human melanoma antigen recognized by tumor- infiltrating lymphocytes associated with in vivo tumor rejection. Proc Natl Acad Sci U S A. Jul. 5, 1994;91(14):6458-62. doi: 10.1073/pnas.91.14.6458.
Kawakami et al., Identification of new melanoma epitopes on melanosomal proteins recognized by tumor infiltrating T lymphocytes restricted by HLA-A1, -A2, and -A3 alleles. J Immunol. Dec. 15, 1998;161(12):6985-92.
Kawakami et al., Identification of the immunodominant peptides of the MART-1 human melanoma antigen recognized by the majority of HLA-A2-restricted tumor infiltrating lymphocytes. J Exp Med. Jul. 1, 1994;180(1):347-52. doi: 10.1084/jem.180.1.347.
Kawakami et al., Recognition of multiple epitopes in the human melanoma antigen gp100 by tumor-infiltrating T lymphocytes associated with in vivo tumor regression. J Immunol. Apr. 15, 1995;154(8):3961-8.
Kawashima et al., Identification of gp100-derived, melanoma-specific cytotoxic T-lymphocyte epitopes restricted by HLA-A3 supertype molecules by primary in vitro immunization with peptide-

(56) References Cited

OTHER PUBLICATIONS pulsed dendritic cells. Int J Cancer. Nov. 9, 1998;78(4):518-24. doi: 10.1002/(sici)1097-0215(Nov. 9, 1998)78:4<518::aid-ijc20>3.0.co;2-0.

Kawashima et al., Identification of HLA-A3-restricted cytotoxic T lymphocyte epitopes from carcinoembryonic antigen and HER-2/neu by primary in vitro immunization with peptide-pulsed dendritic cells. Cancer Res. Jan. 15, 1999;59(2):431-5.

Kawashima et al., The multi-epitope approach for immunotherapy for cancer: identification of several CTL epitopes from various tumor-associated antigens expressed on solid epithelial tumors. Hum Immunol. Jan. 1998;59(1):1-14. doi: 10.1016/s0198-8859(97)00255-3.

Kemmler et al., Elevated tumor-associated antigen expression suppresses variant peptide vaccine responses. J Immunol. Nov. 1, 2011;187(9):4431-9. doi: 10.4049/jimmunol.1101555. Epub Sep. 21, 2011.

Kim et al., AAV-deliverable hypercompact adenine base editors based on transposase B guided by engineered RNA. Research Square. Apr. 12, 2022. DOI: 10.21203/r9.3.rs-1326630/v1. Retrieved from https://www.researchsquare.com/articleIrs-1326630/v1 on Aug. 1, 2023. 20 pages.

Kim et al., Adenine base editors catalyze cytosine conversions in human cells. Nat Biotechnol. Oct. 2019;37(10):1145-1148. doi: 10.1038/s41587-019-0254-4. Epub Sep. 23, 2019.

Kirshenboim et al., Expression and characterization of a novel reverse transcriptase of the LTR retrotransposon Tf1. Virology. Sep. 30, 2007;366(2):263-76. doi: 10.1016/j.virol.2007.04.002. Epub May 23, 2007.

Kittlesen et al., Human melanoma patients recognize an HLA-A1-restricted CTL epitope from tyrosinase containing two cysteine residues: implications for tumor vaccine development. J Immunol. Mar. 1, 1998;160(5):2099-106. Erratum in: J Immunol Mar. 1, 1999;162(5):3106. Shabanowitz JA [corrected to Shabanowitz J].

Kizer et al., Application of functional genomics to pathway optimization for increased isoprenoid production. Appl Environ Microbiol. May 2008;74(10):3229-41. doi: 10.1128/AEM.02750-07. Epub Mar. 14, 2008.

Knipping et al., Disruption of HIV-1 co-receptors CCR5 and CXCR4 in primary human T cells and hematopoietic stem and progenitor cells using base editing. Mol Ther. Jan. 5, 2022;30(1):130-144. doi: 10.1016/j.ymthe.2021.10.026. Epub Nov. 2, 2021.

Knott et al., CRISPR-Cas guides the future of genetic engineering. Science. Aug. 31, 2018;361(6405):866-869. doi: 10.1126/science.aat5011.

Kobayashi et al., CD4+ T cells from peripheral blood of a melanoma patient recognize peptides derived from nonmutated tyrosinase. Cancer Res. Jan. 15, 1998;58(2):296-301.

Kobayashi et al., Identification of an antigenic epitope for helper T lymphocytes from carcinoembryonic antigen. Clin Cancer Res. Oct. 2002;8(10):3219-25.

Kobayashi et al., Identification of helper T-cell epitopes that encompass or lie proximal to cytotoxic T-cell epitopes in the gp 100 melanoma tumor antigen. Cancer Res. Oct. 15, 2001;61(20):7577-84.

Konishi et al., Amino acid substitutions away from the RNase H catalytic site increase the thermal stability of Moloney murine leukemia virus reverse transcriptase through RNase H inactivation. Biochem Biophys Res Commun. Nov. 14, 2014;454(2):269-74. doi: 10.1016/j.bbrc.2014.10.044. Epub Oct. 17, 2014.

Kotterman et al., Engineering adeno-associated viruses for clinical gene therapy. Nat Rev Genet. Jul. 2014;15(7):445-51. doi: 10.1038/nrg3742. Epub May 20, 2014.

Ku et al., Nucleic Acid Aptamers: An Emerging Tool for Biotechnology and Biomedical Sensing. Sensors (Basel). Jul. 6, 2015;15(7):16281-313. doi: 10.3390/s150716281.

Kuan et al., A systematic evaluation of nucleotide properties for CRISPR sgRNA design. BMC Bioinformatics. Jun. 6, 2017;18(1):297. doi: 10.1186/s12859-017-1697-6.

Kuang et al., Advances in base editing with an emphasis on an AAV-based strategy. Methods. Oct. 2021;194:56-64. doi: 10.1016/j.ymeth.2021.03.015. Epub Mar. 25, 2021.

Kueh et al., The new editor-targeted genome engineering in the absence of homology-directed repair. Cell Death Discov. Jun. 13, 2016;2:16042. doi: 10.1038/cddiscovery.2016.42.

Kunkel et al., DNA mismatch repair. Annu Rev Biochem. 2005;74:681-710. doi: 10.1146/annurev.biochem.74.082803.133243.

Kurt et al., CRISPR C-to-G base editors for inducing targeted DNA transversions in human cells. Nat Biotechnol. Jan. 2021;39(1):41-46. doi: 10.1038/s41587-020-0609-x. Epub Jul. 20, 2020.

Kushnir et al., Virus-like particles as a highly efficient vaccine platform: diversity of targets and production systems and advances in clinical development. Vaccine. Dec. 17, 2012;31(1):58-83. doi: 10.1016/j.vaccine.2012.10.083. Epub Nov. 6, 2012.

Kweon et al., A CRISPR-based base-editing screen for the functional assessment of BRCA1 variants. Oncogene. Jan. 2020;39(1):30-35. doi: 10.1038/s41388-019-0968-2. Epub Aug. 29, 2019.

Kwok et al., G-Quadruplexes: Prediction, Characterization, and Biological Application. Trends Biotechnol. Oct. 2017;35(10):997-1013. doi: 10.1016/j.tibtech.2017.06.012. Epub Jul. 26, 2017.

Kwon et al., Precision targeting tumor cells using cancer-specific InDel mutations with CRISPR-Cas9. Proc Natl Acad Sci U S A. Mar. 1, 2022;119(9):e2103532119. doi: 10.1073/pnas.2103532119.

Lahue et al., DNA mismatch correction in a defined system. Science. Jul. 14, 1989;245(4914):160-4. doi: 10.1126/science.2665076.

Lally et al., Unmasking cryptic epitopes after loss of immunodominant tumor antigen expression through epitope spreading. Int J Cancer. Sep. 2001;93(6):841-7. doi: 10.1002/ijc.1420.

Langer et al., Chemical and Physical Structure of Polymers as Carriers for Controlled Release of Bioactive Agents: A Review. J Macromol Sci, Part C, 1983;23(1):61-126. doi: 10.1080/07366578308079439.

Lapointe et al., Retrovirally transduced human dendritic cells can generate T cells recognizing multiple MHC class I and class II epitopes from the melanoma antigen glycoprotein 100. J Immunol. Oct. 15, 2001;167(8):4758-64. doi: 10.4049/jimmunol.167.8.4758.

Larrieu et al., A HLA-Cw*0701 restricted Melan-A/MART1 epitope presented by melanoma tumor cells to CD8+ tumor infiltrating lymphocytes. Cancer Immunol Immunother. May 2008;57(5):745-52. doi: 10.1007/s00262-007-0436-7. Epub Dec. 21, 2007.

Latham et al., Formation of wild-type and chimeric influenza virus-like particles following simultaneous expression of only four structural proteins. J Virol. Jul. 2001;75(13):6154-65. doi: 10.1128/JVI.75.13.6154-6165.2001.

Le et al., SMNDelta7, the major product of the centromeric survival motor neuron (SMN2) gene, extends survival in mice with spinal muscular atrophy and associates with full-length SMN. Hum Mol Genet. Mar. 15, 2005;14(6):845-57. doi: 10.1093/hmg/ddi078. Epub Feb. 9, 2005.

Leach et al., Mutations of a mutS homolog in hereditary nonpolyposis colorectal cancer. Cell. Dec. 17, 1993;75(6):1215-25. doi: 10.1016/0092-8674(93)90330-s.

Lee et al., Mitochondrial DNA editing in mice with DddA-TALE fusion deaminases. Nat Commun. Feb. 19, 2021;12(1):1190. doi: 10.1038/s41467-021-21464-1.

Lee et al., Single C-to-T substitution using engineered APOBEC3G-nCas9 base editors with minimum genome- and transcriptome-wide off-target effects. Sci Adv. Jul. 15, 2020;6(29):eaba1773. doi: 10.1126/sciadv.aba1773. 13 pages.

Lefebvre et al., Identification and characterization of a spinal muscular atrophy-determining gene. Cell. Jan. 13, 1995;80(1):155-65. doi: 10.1016/0092-8674(95)90460-3.

Lennerz et al., The response of autologous T cells to a human melanoma is dominated by mutated neoantigens. Proc Natl Acad Sci U S A. Nov. 1, 2005;102(44):16013-8. doi: 10.1073/pnas.0500090102. Epub Oct. 24, 2005.

Lesinski et al., The potential for targeting the STAT3 pathway as a novel therapy for melanoma. Future Oncol. Jul. 2013;9(7):925-7. doi: 10.2217/fon.13.83. Author Manuscript. 4 pages.

(56) References Cited

OTHER PUBLICATIONS

Li et al., Expression and self-assembly of empty virus-like particles of hepatitis E virus. J Virol. Oct. 1997;71(10):7207-13. doi: 10.1128/JVI.71.10.7207-7213.1997.

Li et al., The Importance of Glycans of Viral and Host Proteins in Enveloped Virus Infection. Front Immunol. Apr. 29, 2021;12:638573. doi: 10.3389/fimmu.2021.638573.

Lim et al., Nuclear and mitochondrial DNA editing in human cells with zinc finger deaminases. Nat Commun. Jan. 18, 2022;13(1):366. doi: 10.1038/s41467-022-27962-0.

Lin et al., [Construction and evaluation of DnaB split intein high expression vector and a six amino acids cyclic peptide library]. Sheng Wu Gong Cheng Xue Bao. Nov. 2008;24(11):1924-30. Chinese.

Lin et al., Base editing-mediated splicing correction therapy for spinal muscular atrophy. Cell Res. Jun. 2020;30(6):548-550. doi: 10.1038/s41422-020-0304-y. Epub Mar. 24, 2020.

Lin et al., HLA-DPB1*05: 01-restricted WT1332-specific TCR-transduced CD4+ T lymphocytes display a helper activity for WT1-specific CTL induction and a cytotoxicity against leukemia cells. J Immunother. Apr. 2013;36(3):159-70. doi: 10.1097/CJI.0b013e3182873581.

Liu et al., Intrinsic Nucleotide Preference of Diversifying Base Editors Guides Antibody Ex Vivo Affinity Maturation. Cell Rep. Oct. 23, 2018;25(4):884-892.e3. doi: 10.1016/j.celrep.2018.09.090.

Liu et al., Usherin is required for maintenance of retinal photoreceptors and normal development of cochlear hair cells. Proc Natl Acad Sci U S A. Mar. 13, 2007;104(11):4413-8. doi: 10.1073/pnas.0610950104. Epub Mar. 5, 2007.

Longsworth, Expanding the Enzymatic Activity of the Programmable Endonuclease Cas9 in Zebrafish. Thesis. Rice University. Houston, TX. May 17, 2019. 41 pages.

Lorson et al., A single nucleotide in the SMN gene regulates splicing and is responsible for spinal muscular atrophy. Proc Natl Acad Sci U S A. May 25, 1999;96(11):6307-11. doi: 10.1073/pnas.96.11.6307.

Lu, Periodic Chart of Amino Acid PDF. Accessed on the internet at https://figshare.com/articles/figure/periodic_chart_of_amino_acid_pdf/3445001/1. Posted Jun. 21, 2016. www.bachem.com. 1 page.

Ludwig et al., Virus-like particles-universal molecular toolboxes. Curr Opin Biotechnol. Dec. 2007;18(6):537-45. doi: 10.1016/j.copbio.2007.10.013.

Lueck et al., Engineered transfer RNAs for suppression of premature termination codons. Nat Commun. Feb. 18, 2019;10(1):822. doi: 10.1038/s41467-019-08329-4.

Lujan et al., Heterogeneous polymerase fidelity and mismatch repair bias genome variation and composition. Genome Res. Nov. 2014;24(11):1751-64. doi: 10.1101/gr.178335.114. Epub Sep. 12, 2014.

Lupetti et al., Translation of a retained intron in tyrosinase-related protein (TRP) 2 mRNA generates a new cytotoxic T lymphocyte (CTL)-defined and shared human melanoma antigen not expressed in normal cells of the melanocytic lineage. J Exp Med. Sep. 21, 1998;188(6):1005-16. doi: 10.1084/jem.188.6.1005.

Lutz et al., Postsymptomatic restoration of SMN rescues the disease phenotype in a mouse model of severe spinal muscular atrophy. J Clin Invest. Aug. 2011;121(8):3029-41. doi: 10.1172/JCI57291. Epub Jul. 25, 2011.

Lyu et al., Adenine Base Editor Ribonucleoproteins Delivered by Lentivirus-Like Particles Show High On-Target Base Editing and Undetectable RNA Off-Target Activities. CRISPR J. Feb. 2021;4(1):69-81. doi: 10.1089/crispr.2020.0095.

Lyu et al., Delivering Cas9/sgRNA ribonucleoprotein (RNP) by lentiviral capsid-based bionanoparticles for efficient 'hit-and-run' genome editing. Nucleic Acids Res. Sep. 26, 2019;47(17):e99. doi: 10.1093/nar/gkz605.

Lyu et al., Virus-Like Particle Mediated CRISPR/Cas9 Delivery for Efficient and Safe Genome Editing. Life (Basel). Dec. 21, 2020;10(12):366. doi: 10.3390/life10120366.

MacFadden et al., Mechanism and structural diversity of exoribonuclease-resistant RNA structures in flaviviral RNAs. Nat Commun. Jan. 9, 2018;9(1):119. doi: 10.1038/s41467-017-02604-y.

Maerker et al., A novel Usher protein network at the periciliary reloading point between molecular transport machineries in vertebrate photoreceptor cells. Hum Mol Genet. Jan. 1, 2008;17(1):71-86. doi: 10.1093/hmg/ddm285. Epub Sep. 28, 2007.

Maetzig et al., Retroviral protein transfer: falling apart to make an impact. Curr Gene Ther. Oct. 2012;12(5):389-409. doi: 10.2174/156652312802762581.

Mahoney et al., The Next Immune-Checkpoint Inhibitors: PD-1/PD-L1 Blockade in Melanoma. Clin Ther. Apr. 1, 2015;37(4):764-82. doi: 10.1016/j.clinthera.2015.02.018. Epub Mar. 29, 2015.

Mali et al., CAS9 transcriptional activators for target specificity screening and paired nickases for cooperative genome engineering. Nat Biotechnol. Sep. 2013;31(9):833-8, Supplemental Info. doi: 10.1038/nbt.2675. Epub Aug. 1, 2013.

Mandic et al., The alternative open reading frame of LAGE-1 gives rise to multiple promiscuous HLA-DR-restricted epitopes recognized by T-helper 1-type tumor-reactive CD4+ T cells. Cancer Res. Oct. 1, 2003;63(19):6506-15.

Mangeot et al., A universal transgene silencing method based on RNA interference. Nucleic Acids Res. Jul. 12, 2004;32(12):e102. doi: 10.1093/nar/gnh105.

Mangeot et al., Development of minimal lentivirus vectors derived from simian immunodeficiency virus (SIVmac251) and their use for gene transfer into human dendritic cells. J Virol. Sep. 2000;74(18):8307-15. doi: 10.1128/jvi.74.18.8307-8315.2000.

Mangeot et al., Genome editing in primary cells and in vivo using viral-derived Nanoblades loaded with Cas9-sgRNA ribonucleoproteins. Nat Commun. Jan. 3, 2019;10(1):45. doi: 10.1038/s41467-018-07845-z.

Mangeot et al., Protein transfer into human cells by VSV-G-induced nanovesicles. Mol Ther. Sep. 2011;19(9):1656-66. doi: 10.1038/mt.2011.138. Epub Jul. 12, 2011.

Marcovitz et al., Frustration in protein-DNA binding influences conformational switching and target search kinetics. Proc Natl Acad Sci U S A. Nov. 1, 2011;108(44):17957-62. doi: 10.1073/pnas.1109594108. Epub Oct. 14, 2011.

Mariani et al., Species-specific exclusion of APOBEC3G from HIV-1 virions by Vif. Cell. Jul. 11, 2003;114(1):21-31. doi: 10.1016/s0092-8674(03)00515-4.

Mendell et al., Single-Dose Gene-Replacement Therapy for Spinal Muscular Atrophy. N Engl J Med. Nov. 2, 2017;377(18):1713-1722. doi: 10.1056/NEJMoa1706198.

Meng et al., Identification of an HLA-DPB1*0501 restricted Melan-A/MART-1 epitope recognized by CD4+ T lymphocytes: prevalence for immunotherapy in Asian populations. J Immunother. Sep. 2011;34(7):525-34. doi: 10.1097/CJI.0b013e318226bd45. Author Manuscript. 16 pages.

Miccio et al., Novel genome-editing-based approaches to treat motor neuron diseases: Promises and challenges. Mol Ther. Jan. 5, 2022;30(1):47-53. doi: 10.1016/j.ymthe.2021.04.003. Epub Apr. 3, 2021.

Michaux et al., A spliced antigenic peptide comprising a single spliced amino acid is produced in the proteasome by reverse splicing of a longer peptide fragment followed by trimming. J Immunol. Feb. 15, 2014;192(4):1962-71. doi: 10.4049/jimmunol.1302032. Epub Jan. 22, 2014.

Micozzi et al., Human cytidine deaminase: a biochemical characterization of its naturally occurring variants. Int J Biol Macromol. Feb. 2014;63:64-74. doi: 10.1016/j.ijbiomac.2013.10.029. Epub Oct. 29, 2013. Erratum in: Int J Biol Macromol. Feb. 2014;63:262.

Millevoi et al., G-quadruplexes in RNA biology. Wiley Interdiscip Rev RNA. Jul.-Aug. 2012;3(4):495-507. doi: 10.1002/wrna.1113. Epub Apr. 4, 2012.

Milone et al., Clinical use of lentiviral vectors. Leukemia. Jul. 2018;32(7):1529-1541. doi: 10.1038/s41375-018-0106-0. Epub Mar. 22, 2018.

Min et al., Deep learning in bioinformatics. Brief Bioinform. Sep. 1, 2017;18(5):851-869. doi: 10.1093/bib/bbw068.

(56) References Cited

OTHER PUBLICATIONS

Misra et al., An enzymatically active chimeric HIV-1 reverse transcriptase (RT) with the RNase-H domain of murine leukemia virus RT exists as a monomer. J Biol Chem. Apr. 17, 1998;273(16):9785-9. doi: 10.1074/jbc.273.16.9785.
Momose et al., Diving into marine genomics with CRISPR/Cas9 systems. Mar Genomics. Dec. 2016;30:55-65. doi: 10.1016/j.margen.2016.10.003. Epub Oct. 12, 2016.
Monani et al., A single nucleotide difference that alters splicing patterns distinguishes the SMA gene SMN1 from the copy gene SMN2. Hum Mol Genet. Jul. 1999;8(7):1177-83. doi: 10.1093/hmg/8.7.1177.
Morel et al., A tyrosinase peptide presented by HLA-B35 is recognized on a human melanoma by autologous cytotoxic T lymphocytes. Int J Cancer. Dec. 10, 1999;83(6):755-9. doi: 10.1002/(sici)1097-0215(19991210)83:6<755::aid-ijc10>3.0.co;2-s.
Mselli-Lakhal et al., Gene transfer system derived from the caprine arthritis-encephalitis lentivirus. J Virol Methods. Sep. 2006;136(1-2):177-84. doi: 10.1016/j.jviromet.2006.05.006. Epub Jun. 21, 2006.
Murawski et al., Newcastle disease virus-like particles containing respiratory syncytial virus G protein induced protection in BALB/c mice, with no evidence of immunopathology. J Virol. Jan. 2010;84(2):1110-23. doi: 10.1128/JVI.01709-09. Epub Nov. 4, 2009.
Murray et al., Selective vulnerability of motor neurons and dissociation of pre- and post-synaptic pathology at the neuromuscular junction in mouse models of spinal muscular atrophy. Hum Mol Genet. Apr. 1, 2008;17(7):949-62. doi: 10.1093/hmg/ddm367. Epub Dec. 8, 2007.
Murugan et al., The Revolution Continues: Newly Discovered Systems Expand the CRISPR-Cas Toolkit. Mol Cell. Oct. 5, 2017;68(1):15-25. doi: 10.1016/j.molcel.2017.09.007.
Naskalska et al., Virus Like Particles as Immunogens and Universal Nanocarriers. Pol J Microbiol. 2015;64(1):3-13.
Negre et al., Characterization of novel safe lentiviral vectors derived from simian immunodeficiency virus (SIVmac251) that efficiently transduce mature human dendritic cells. Gene Ther. Oct. 2000;7(19):1613-23. doi: 10.1038/sj.gt.3301292.
Nelson et al., Engineered pegRNAs improve prime editing efficiency. Nat Biotechnol. Mar. 2022;40(3):402-410. doi: 10.1038/s41587-021-01039-7. Epub Oct. 4, 2021. Erratum in: Nat Biotechnol. Mar. 2022;40(3):432. doi: 10.1038/s41587-021-01175-0 and Supplemental Information. 15 pages.
Nelson et al., In vivo genome editing improves muscle function in a mouse model of Duchenne muscular dystrophy. Science. Jan. 22, 2016;351(6271):403-7. doi: 10.1126/science.aad5143. Epub Dec. 31, 2015.
Newby et al., In vivo somatic cell base editing and prime editing. Mol Ther. Nov. 3, 2021;29(11):3107-3124. doi: 10.1016/j.ymthe.2021.09.002. Epub Sep. 10, 2021.
Nguyen Tran et al., Engineering domain-inlaid SaCas9 adenine base editors with reduced RNA off-targets and increased on-target DNA editing. Nat Commun. Sep. 25, 2020;11(1):4871. doi: 10.1038/s41467-020-18715-y.
Niemeyer, C.M., Semisynthetic DNA-protein conjugates for biosensing and nanofabrication. Angew Chem Int Ed Engl. Feb. 8, 2010;49(7):1200-16. doi: 10.1002/anie.200904930.
Noppen et al., Naturally processed and concealed HLA-A2.1-restricted epitopes from tumor-associated antigen tyrosinase-related protein-2. Int J Cancer. Jul. 15, 2000;87(2):241-6.
Nowak et al., Ty3 reverse transcriptase complexed with an RNA-DNA hybrid shows structural and functional asymmetry. Nat Struct Mol Biol. Apr. 2014;21(4):389-96. doi: 10.1038/nsmb.2785. Epub Mar. 9, 2014. Author Manuscript, 22 pages.
Nukaya et al., Identification of HLA-A24 epitope peptides of carcinoembryonic antigen which induce tumor-reactive cytotoxic T lymphocyte. Int J Cancer. Jan. 5, 1999;80(1):92-7. doi: 10.1002/(sici)1097-0215(19990105)80:1<92::aid-ijc18>3.0.co;2-m.
Ogasawara et al., Recombinant viral-like particles of parvovirus B19 as antigen carriers of anthrax protective antigen. In Vivo. May-Jun. 2006;20(3):319-24.
Ohminami et al., HLA class I-restricted lysis of leukemia cells by a CD8(+) cytotoxic T-lymphocyte clone specific for WT1 peptide. Blood. Jan. 1, 2000;95(1):286-93.
Oka et al., WT1 peptide vaccine for the treatment of cancer. Curr Opin Immunol. Apr. 2008;20(2):211-20. doi: 10.1016/j.coi.2008.04.009. Epub May 24, 2008.
Olsen, J.C., Gene transfer vectors derived from equine infectious anemia virus. Gene Ther. Nov. 1998;5(11):1481-7. doi: 10.1038/sj.gt.3300768.
Olson et al., HLA-A2-restricted T-cell epitopes specific for prostatic acid phosphatase. Cancer Immunol Immunother. Jun. 2010;59(6):943-53. doi: 10.1007/s00262-010-0820-6. Epub Feb. 6, 2010.
Osen et al., Screening of human tumor antigens for CD4 T cell epitopes by combination of HLA-transgenic mice, recombinant adenovirus and antigen peptide libraries. PLoS One. Nov. 30, 2010;5(11):e14137. doi: 10.1371/journal.pone.0014137.
Ottesen, ISS-N1 makes the First FDA-approved Drug for Spinal Muscular Atrophy. Transl Neurosci. Jan. 26, 2017;8:1-6. doi: 10.1515/tnsci-2017-0001.
Ousterout et al., Multiplex CRISPR/Cas9-based genome editing for correction of dystrophin mutations that cause Duchenne muscular dystrophy. Nat Commun. Feb. 18, 2015;6:6244. doi: 10.1038/ncomms7244.
Pandey et al., Effect of loops and G-quartets on the stability of RNA G-quadruplexes. J Phys Chem B. Jun. 13, 2013;117(23):6896-905. doi: 10.1021/jp401739m. Epub May 29, 2013. Supplementary Information, 21 pages.
Parente et al., Advances in spinal muscular atrophy therapeutics. Ther Adv Neurol Disord. Feb. 5, 2018;11:1756285618754501. doi: 10.1177/1756285618754501. 13 pages.
Parkhurst et al., Identification of a shared HLA-A*0201-restricted T-cell epitope from the melanoma antigen tyrosinase-related protein 2 (TRP2). Cancer Res. Nov. 1, 1998;58(21):4895-901.
Parkhurst et al., Induction of CD4+ Th1 lymphocytes that recognize known and novel class II MHC restricted epitopes from the melanoma antigen gp100 by stimulation with recombinant protein. J Immunother. Mar.-Apr. 2004;27(2):79-91. doi: 10.1097/00002371-200403000-00001. Author Manuscript. 22 pages.
Parsons et al., Hypermutability and mismatch repair deficiency in RER+ tumor cells. Cell. Dec. 17, 1993;75(6):1227-36. doi: 10.1016/0092-8674(93)90331-j.
Paschen et al., Detection of spontaneous CD4+ T-cell responses in melanoma patients against a tyrosinase-related protein-2-derived epitope identified in HLA-DRB1*0301 transgenic mice. Clin Cancer Res. Jul. 15, 2005;11(14):5241-7. doi: 10.1158/1078-0432.CCR-05-0170.
Passini et al., Antisense oligonucleotides delivered to the mouse CNS ameliorate symptoms of severe spinal muscular atrophy. Sci Transl Med. Mar. 2, 2011;3(72):72ra18. doi: 10.1126/scitranslmed.3001777.
Pendse et al., Exon 13-skipped USH2A protein retains functional integrity in mice, suggesting an exo-skipping therapeutic approach to treat USH2A-associated disease. bioRxiv preprint. Feb. 4, 2020. Retrieved from www.biorxiv.org. doi: 10.1101/2020.02.04.934240. 34 pages.
Pendse et al., In Vivo Assessment of Potential Therapeutic Approaches for USH2A-Associated Diseases. Adv Exp Med Biol. 2019;1185:91-96. doi: 10.1007/978-3-030-27378-1_15.
Perez-Palma et al., Simple ClinVar: an interactive web server to explore and retrieve gene and disease variants aggregated in ClinVar database. Nucleic Acids Res. Jul. 2, 2019;47(W1):W99-W105. doi: 10.1093/nar/gkz411.
Petit et al., Powerful mutators lurking in the genome. Philos Trans R Soc Lond B Biol Sci. Mar. 12, 2009;364(1517):705-15. doi: 10.1098/rstb.2008.0272.
Petri et al., CRISPR prime editing with ribonucleoprotein complexes in zebrafish and primary human cells. Nat Biotechnol. Feb. 2022;40(2):189-193. doi: 10.1038/s41587-021-00901-y. Epub Apr. 29, 2021. Erratum in: Nat Biotechnol. May 13, 2021.
Pijlman et al., A highly structured, nuclease-resistant, noncoding RNA produced by flaviviruses is required for pathogenicity. Cell Host Microbe. Dec. 11, 2008;4(6):579-91. doi: 10.1016/j.chom.2008.10.007.

(56) References Cited

OTHER PUBLICATIONS

Pinilla et al., Combinatorial peptide libraries as an alternative approach to the identification of ligands for tumor-reactive cytolytic T lymphocytes. Cancer Res. Jul. 1, 2001;61(13):5153-60.
Pinilla-Ibarz et al., Improved human T-cell responses against synthetic HLA-0201 analog peptides derived from the WT1 oncoprotein. Leukemia. Nov. 2006;20(11):2025-33. doi: 10.1038/sj.leu.2404380. Epub Aug. 31, 2006.
Piotukh et al., Directed evolution of sortase A mutants with altered substrate selectivity profiles. J Am Chem Soc. Nov. 9, 2011;133(44):17536-9. doi: 10.1021/ja205630g. Epub Oct. 13, 2011.
Plotz et al., N-terminus of hMLH1 confers interaction of hMutLalpha and hMutLbeta with hMutSalpha. Nucleic Acids Res. Jun. 15, 2003;31(12):3217-26. doi: 10.1093/nar/gkg420.
Podracky et al., Laboratory evolution of a sortase enzyme that modifies amyloid-ß protein. Nat Chem Biol. Mar. 2021;17(3):317-325. doi: 10.1038/s41589-020-00706-1. Epub Jan. 11, 2021.
Porensky et al., A single administration of morpholino antisense oligomer rescues spinal muscular atrophy in mouse. Hum Mol Genet. Apr. 1, 2012;21(7):1625-38. doi: 10.1093/hmg/ddr600. Epub Dec. 20, 2011.
Prather et al., De novo biosynthetic pathways: rational design of microbial chemical factories. Curr Opin Biotechnol. Oct. 2008;19(5):468-74. doi: 10.1016/j.copbio.2008.07.009. Epub Sep. 5, 2008.
Quan et al., Influenza M1 VLPs containing neuraminidase induce heterosubtypic cross-protection. Virology. Sep. 1, 2012;430(2):127-35. doi: 10.1016/j.virol.2012.05.006. Epub Jun. 2, 2012.
Raaijmakers et al., CRISPR/Cas Applications in Myotonic Dystrophy: Expanding Opportunities. Int J Mol Sci. Jul. 27, 2019;20(15):3689. doi: 10.3390/ijms20153689.
Rajagopal et al., High-throughput mapping of regulatory DNA. Nat Biotechnol. Feb. 2016;34(2):167-74. doi: 10.1038/nbt.3468. Epub Jan. 25, 2016.
Ramos et al., Age-dependent SMN expression in disease-relevant tissue and implications for SMA treatment. J Clin Invest. Nov. 1, 2019;129(11):4817-4831. doi: 10.1172/JCI124120.
Räschle et al., Mutations within the hMLH1 and hPMS2 subunits of the human MutLalpha mismatch repair factor affect its ATPase activity, but not its ability to interact with hMutSalpha. J Biol Chem. Jun. 14, 2002;277(24):21810-20. doi: 10.1074/jbc.M108787200. Epub Apr. 10, 2002.
Rasmussen et al., Characterization of virus-like particles produced by a recombinant baculovirus containing the gag gene of the bovine immunodeficiency-like virus. Virology. Oct. 1990;178(2):435-51. doi: 10.1016/0042-6822(90)90341-n.
Reiners et al., Scaffold protein harmonin (USH1C) provides molecular links between Usher syndrome type 1 and type 2. Hum Mol Genet. Dec. 15, 2005;14(24):3933-43. doi: 10.1093/hmg/ddi417. Epub Nov. 21, 2005.
Renner et al., Intact Viral Particle Counts Measured by Flow Virometry Provide Insight into the Infectivity and Genome Packaging Efficiency of Moloney Murine Leukemia Virus. J Virol. Jan. 6, 2020;94(2):e01600-19. doi: 10.1128/JVI.01600-19.
Riddle et al., Frameshift suppression: a nucleotide addition in the anticodon of a glycine transfer RNA. Nat New Biol. Apr. 25, 1973;242(121):230-4. doi: 10.1038/newbio242230a0.
Riddle et al., Frameshift suppressors. II. Genetic mapping and dominance studies. J Mol Biol. May 28, 1972;66(3):483-93. doi: 10.1016/0022-2836(72)90428-7.
Riddle et al., Suppressors of frameshift mutations in *Salmonella typhimurium*. J Mol Biol. Nov. 28, 1970;54(1):131-44. doi: 10.1016/0022-2836(70)90451-1.
Riley et al., Identification of a new shared HLA-A2.1 restricted epitope from the melanoma antigen tyrosinase. J Immunother. May-Jun. 2001;24(3):212-20.
Rimoldi et al., Efficient simultaneous presentation of NY-ESO-1/LAGE-1 primary and nonprimary open reading frame-derived CTL epitopes in melanoma. J Immunol. Dec. 15, 2000;165(12):7253-61. doi: 10.4049/jimmunol.165.12.7253.
Robbins et al., Multiple HLA class II-restricted melanocyte differentiation antigens are recognized by tumor-infiltrating lymphocytes from a patient with melanoma. J Immunol. Nov. 15, 2002;169(10):6036-47. doi: 10.4049/jimmunol.169.10.6036.
Robbins et al., The intronic region of an incompletely spliced gp100 gene transcript encodes an epitope recognized by melanoma-reactive tumor-infiltrating lymphocytes. J Immunol. Jul. 1, 1997;159(1):303-8.
Robert et al., Virus-Like Particles Derived from HIV-1 for Delivery of Nuclear Proteins: Improvement of Production and Activity by Protein Engineering. Mol Biotechnol. Jan. 2017;59(1):9-23. doi: 10.1007/s12033-016-9987-1.
Rodriguez-Muela et al., Single-Cell Analysis of SMN Reveals Its Broader Role in Neuromuscular Disease. Cell Rep. Feb. 7, 2017;18(6):1484-1498 and Supplemental Information. doi: 10.1016/j.celrep.2017.01.035.
Rohovie et al., Virus-like particles: Next-generation nanoparticles for targeted therapeutic delivery. Bioeng Transl Med. Jan. 19, 2017;2(1):43-57. doi: 10.1002/btm2.10049.
Rosenberg et al., Immunologic and therapeutic evaluation of a synthetic peptide vaccine for the treatment of patients with metastatic melanoma. Nat Med. Mar. 1998;4(3):321-7. doi: 10.1038/nm0398-321.
Rubio-Godoy et al., Toward synthetic combinatorial peptide libraries in positional scanning format (PS-SCL)-based identification of CD8+ Tumor-reactive T-Cell Ligands: a comparative analysis of PS-SCL recognition by a single tumor-reactive CD8+ cytolytic T-lymphocyte clone. Cancer Res. Apr. 1, 2002;62(7):2058-63.
Ruiz et al., Identification and characterization of a T-helper peptide from carcinoembryonic antigen. Clin Cancer Res. Apr. 15, 2004;10(8):2860-7. doi: 10.1158/1078-0432.ccr-03-0476.
Rusk, Cas9 and the importance of asymmetry. Nat Methods. Apr. 2016;13(4):286-7. doi: 10.1038/nmeth.3826.
Saayman et al., The therapeutic application of CRISPR/Cas9 technologies for HIV. Expert Opin Biol Ther. Jun. 2015;15(6):819-30. doi: 10.1517/14712598.2015.1036736. Epub Apr. 12, 2015.
Sadowski et al., The sequence-structure relationship and protein function prediction. Curr Opin Struct Biol. Jun. 2009;19(3):357-62. doi: 10.1016/j.sbi.2009.03.008. Epub May 4, 2009.
Saenger et al., Improved tumor immunity using anti-tyrosinase related protein-1 monoclonal antibody combined with DNA vaccines in murine melanoma. Cancer Res. Dec. 1, 2008;68(23):9884-91. doi: 10.1158/0008-5472.CAN-08-2233. Author Manuscript. 19 pages.
Saenz et al., Feline immunodeficiency virus-based lentiviral vectors. Cold Spring Harb Protoc. Jan. 1, 2012;2012(1):71-6. doi: 10.1101/pdb.ip067579.
Saenz et al., Production, harvest, and concentration of feline immunodeficiency virus-based lentiviral vector from cells grown in CF10 or CF2 devices. Cold Spring Harb Protoc. Jan. 1, 2012;2012(1):118-23. doi: 10.1101/pdb.prot067546.
Sakuma et al., Multiplex genome engineering in human cells using all-in-one CRISPR/Cas9 vector system. Sci Rep. Jun. 23, 2014;4:5400. doi: 10.1038/srep05400.
Sanjurjo-Soriano et al., Genome Editing in Patient iPSCs Corrects the Most Prevalent USH2A Mutations and Reveals Intriguing Mutant mRNA Expression Profiles. Mol Ther Methods Clin Dev. Nov. 27, 2019;17:156-173. doi: 10.1016/j.omtm.2019.11.016.
Schneider et al., Overlapping peptides of melanocyte differentiation antigen Melan-A/MART-1 recognized by autologous cytolytic T lymphocytes in association with HLA-B45.1 and HLA-A2.1. Int J Cancer. Jan. 30, 1998;75(3):451-8. doi: 10.1002/(sici)1097-0215(19980130)75:3<451::aid-ijc20>3.0.co;2-a.
Scholefield et al., Prime editing—an update on the field. Gene Ther. Aug. 2021;28(7-8):396-401. doi: 10.1038/s41434-021-00263-9. Epub May 24, 2021.
Schrank et al., Inactivation of the survival motor neuron gene, a candidate gene for human spinal muscular atrophy, leads to massive cell death in early mouse embryos. Proc Natl Acad Sci U S A. Sep. 2, 1997;94(18):9920-5. doi: 10.1073/pnas.94.18.9920.
Score Results for US 2014-0186919 A1 to Zhang et al. Aug. 28, 2014. 3 pages.

(56) References Cited

OTHER PUBLICATIONS

Seffernick et al., Melamine deaminase and atrazine chlorohydrolase: 98 percent identical but functionally different. J Bacteriol. Apr. 2001;183(8):2405-10. doi: 10.1128/JB.183.8.2405-2410.2001.
Sensi et al., Identification of a novel gp100/pMel17 peptide presented by HLA-A*6801 and recognized on human melanoma by cytolytic T cell clones. Tissue Antigens. Apr. 2002;59(4):273-9. doi: 10.1034/j.1399-0039.2002.590404.x.
Shalaby et al., Tissue-Specific Delivery of CRISPR Therapeutics: Strategies and Mechanisms of Non-Viral Vectors. Int J Mol Sci. Oct. 5, 2020;21(19):7353. doi: 10.3390/ijms21197353.
Shang et al., The spontaneous CD8+ T-cell response to HLA-A2-restricted NY-ESO-1b peptide in hepatocellular carcinoma patients. Clin Cancer Res. Oct. 15, 2004;10(20):6946-55. doi: 10.1158/1078-0432.CCR-04-0502.
Sharma et al., Noninfectious virus-like particles produced by Moloney murine leukemia virus-based retrovirus packaging cells deficient in viral envelope become infectious in the presence of lipofection reagents. Proc Natl Acad Sci U S A. Sep. 30, 1997;94(20):10803-8. doi: 10.1073/pnas.94.20.10803.
Shcherbakova et al., Mutator phenotypes conferred by MLH1 overexpression and by heterozygosity for mlh1 mutations. Mol Cell Biol. Apr. 1999;19(4):3177-83. doi: 10.1128/MCB.19.4.3177.
Shellenberger et al., A recombinant polypeptide extends the in vivo half-life of peptides and proteins in a tunable manner. Nat Biotechnol. Dec. 2009;27(12):1186-90. doi: 10.1038/nbt.1588.
Shen et al., Identification of a MHC class-II restricted epitope in carcinoembryonic antigen. Cancer Immunol Immunother. May 2004;53(5):391-403. doi: 10.1007/s00262-003-0455-y. Epub Nov. 18, 2003.
Shim et al., Nonviral Delivery Systems for Cancer Gene Therapy: Strategies and Challenges. Curr Gene Ther. 2018;18(1):3-20. doi: 10.2174/1566523218666180119121949.
Simon et al., Retrons and their applications in genome engineering. Nucleic Acids Res. Dec. 2, 2019;47(21):11007-11019. doi: 10.1093/nar/gkz865.
Singh et al., Protein Engineering Approaches in the Post-Genomic Era. Curr Protein Pept Sci. 2018;19(1):5-15. doi: 10.2174/1389203718666161117114243.
Singh et al., Splicing of a critical exon of human Survival Motor Neuron is regulated by a unique silencer element located in the last intron. Mol Cell Biol. Feb. 2006;26(4):1333-46. doi: 10.1128/MCB.26.4.1333-1346.2006.
Skipper et al., An HLA-A2-restricted tyrosinase antigen on melanoma cells results from posttranslational modification and suggests a novel pathway for processing of membrane proteins. J Exp Med. Feb. 1, 1996;183(2):527-34. doi: 10.1084/jem.183.2.527.
Skipper et al., Shared epitopes for HLA-A3-restricted melanoma-reactive human CTL include a naturally processed epitope from Pmel-17/gp100. J Immunol. Dec. 1, 1996;157(11):5027-33.
Slansky et al., Enhanced antigen-specific antitumor immunity with altered peptide ligands that stabilize the MHC-peptide-TCR complex. Immunity. Oct. 2000;13(4):529-38. doi: 10.1016/s1074-7613(00)00052-2.
Slingluff et al., Clinical and immunologic results of a randomized phase II trial of vaccination using four melanoma peptides either administered in granulocyte-macrophage colony-stimulating factor in adjuvant or pulsed on dendritic cells. J Clin Oncol. Nov. 1, 2003;21(21):4016-26. doi: 10.1200/JCO.2003.10.005.
Slingluff et al., Immunologic and clinical outcomes of vaccination with a multiepitope melanoma peptide vaccine plus low-dose interleukin-2 administered either concurrently or on a delayed schedule. J Clin Oncol. Nov. 15, 2004;22(22):4474-85. doi: 10.1200/JCO.2004.10.212.
Sorusch et al., Characterization of the ternary Usher syndrome SANS/ush2a/whirlin protein complex. Hum Mol Genet. Mar. 15, 2017;26(6):1157-1172. doi: 10.1093/hmg/ddx027.
Steckelberg et al., A folded viral noncoding RNA blocks host cell exoribonucleases through a conformationally dynamic RNA structure. Proc Natl Acad Sci U S A. Jun. 19, 2018;115(25):6404-6409. doi: 10.1073/pnas.1802429115. Epub Jun. 4, 2018.
Strand et al., Destabilization of tracts of simple repetitive DNA in yeast by mutations affecting DNA mismatch repair. Nature. Sep. 16, 1993;365(6443):274-6. doi: 10.1038/365274a0. Erratum in: Nature Apr. 7, 1994;368(6471);569.
Studebaker et al., Depletion of uracil-DNA glycosylase activity is associated with decreased cell proliferation. Biochem Biophys Res Commun. Aug. 26, 2005;334(2):509-15. doi: 10.1016/j.bbrc.2005.06.118.
Su et al., Mispair specificity of methyl-directed DNA mismatch correction in vitro. J Biol Chem. May 15, 1988;263(14):6829-35. Erratum in: J Biol Chem Aug. 5, 1988;263(22):11015.
Sugawara et al., Heteroduplex rejection during single-strand annealing requires Sgs1 helicase and mismatch repair proteins Msh2 and Msh6 but not Pms1. Proc Natl Acad Sci U S A. Jun. 22, 2004;101(25):9315-20. doi: 10.1073/pnas.0305749101. Epub Jun. 15, 2004.
Suh et al., Publisher Correction: Restoration of visual function in adult mice with an inherited retinal disease via adenine base editing. Nat Biomed Eng. Nov. 2020;4(11):1119. doi: 10.1038/s41551-020-00652-2. Erratum for: Nat Biomed Eng. Oct. 19, 2020.
Sumner et al., Two breakthrough gene-targeted treatments for spinal muscular atrophy: challenges remain. J Clin Invest. Aug. 1, 2018;128(8):3219-3227. doi: 10.1172/JCI121658. Epub Jul. 9, 2018.
Supek et al., Differential DNA mismatch repair underlies mutation rate variation across the human genome. Nature. May 7, 2015;521(7550):81-4. doi: 10.1038/nature14173. Epub Feb. 23, 2015.
Svitashev et al., Targeted Mutagenesis, Precise Gene Editing, and Site-Specific Gene Insertion in Maize Using Cas9 and Guide RNA. Plant Physiol. Oct. 2015;169(2):931-45. doi: 10.1104/pp.15.00793. Epub Aug. 12, 2015.
Talbot et al., Spinal muscular atrophy. Semin Neurol. Jun. 2001;21(2):189-97. doi: 10.1055/s-2001-15264.
Tan et al., Engineering of high-precision base editors for site-specific single nucleotide replacement. Nat Commun. Jan. 25, 2019;10(1):439. doi: 10.1038/s41467-018-08034-8. Erratum in: Nat Commun. May 1, 2019;10(1):2019.
Tang et al., Identification of Dehalobacter reductive dehalogenases that catalyse dechlorination of chloroform, 1,1,1-trichloroethane and 1,1-dichloroethane. Philos Trans R Soc Lond B Biol Sci. Mar. 11, 2013;368(1616):20120318. doi: 10.1098/rstb.2012.0318.
Tang et al., The *Arabidopsis* TRM61/TRM6 complex is a bona fide tRNA N1-methyladenosine methyltransferase. J Exp Bot. May 30, 2020;71(10):3024-3036. doi: 10.1093/jxb/eraa100.
Tangri et al., Structural features of peptide analogs of human histocompatibility leukocyte antigen class I epitopes that are more potent and immunogenic than wild-type peptide. J Exp Med. Sep. 17, 2001;194(6):833-46. doi: 10.1084/jem.194.6.833.
Thandapani et al., Valine tRNA levels and availability regulate complex I assembly in leukaemia. Nature. Jan. 2022;601(7893):428-433. doi: 10.1038/s41586-021-04244-1. Epub Dec. 22, 2021.
Thomas et al., Heteroduplex repair in extracts of human HeLa cells. J Biol Chem. Feb. 25, 1991;266(6):3744-51.
Tomé-Amat et al., Secreted production of assembled Norovirus virus-like particles from Pichia pastoris. Microb Cell Fact. Sep. 10, 2014;13:134. doi: 10.1186/s12934-014-0134-z.
Tomer et al., Contribution of human mlh1 and pms2 ATPase activities to DNA mismatch repair. J Biol Chem. Jun. 14, 2002;277(24):21801-9. doi: 10.1074/jbc.M111342200. Epub Mar. 15, 2002.
Topalian et al., Melanoma-specific CD4+ T cells recognize nonmutated HLA-DR-restricted tyrosinase epitopes. J Exp Med. May 1, 1996;183(5):1965-71. doi: 10.1084/jem.183.5.1965.
Toro et al., Comprehensive phylogenetic analysis of bacterial reverse transcriptases. PLoS One. Nov. 25, 2014;9(11):e114083. doi: 10.1371/journal.pone.0114083.
Touloukian et al., Expression of a "self-"antigen by human tumor cells enhances tumor antigen-specific CD4(+) T-cell function. Cancer Res. Sep. 15, 2002;62(18):5144-7. Author Manuscript. 11 pages.

(56) References Cited

OTHER PUBLICATIONS

Touloukian et al., Identification of a MHC class II-restricted human gp100 epitope using DR4-IE transgenic mice. J Immunol. Apr. 1, 2000;164(7):3535-42. doi: 10.4049/jimmunol.164.7.3535.
Touloukian et al., Normal tissue depresses while tumor tissue enhances human T cell responses in vivo to a novel self/tumor melanoma antigen, OA1. J Immunol. Feb. 1, 2003;170(3):1579-85. doi: 10.4049/jimmunol.170.3.1579.
Tran et al., Hypermutability of homonucleotide runs in mismatch repair and DNA polymerase proofreading yeast mutants. Mol Cell Biol. May 1997;17(5):2859-65. doi: 10.1128/MCB.17.5.2859.
Trojan et al., Generation of cytotoxic T lymphocytes against native and altered peptides of human leukocyte antigen-A*0201 restricted epitopes from the human epithelial cell adhesion molecule. Cancer Res. Jun. 15, 2001;61(12):4761-5.
Tsai et al., Identification of subdominant CTL epitopes of the GP100 melanoma-associated tumor antigen by primary in vitro immunization with peptide-pulsed dendritic cells. J Immunol. Feb. 15, 1997;158(4):1796-802.
Tsang et al., A human cytotoxic T-lymphocyte epitope and its agonist epitope from the nonvariable number of tandem repeat sequence of MUC-1. Clin Cancer Res. Mar. 15, 2004;10(6):2139-49. doi: 10.1158/1078-0432.ccr-1011-03.
Tsang et al., Generation of human cytotoxic T cells specific for human carcinoembryonic antigen epitopes from patients immunized with recombinant vaccinia-CEA vaccine. J Natl Cancer Inst. Jul. 5, 1995;87(13):982-90. doi: 10.1093/jnci/87.13.982.
Tsuboi et al., Enhanced induction of human WT1-specific cytotoxic T lymphocytes with a 9-mer WT1 peptide modified at HLA-A*2402-binding residues. Cancer Immunol Immunother. Dec. 2002;51(11-12):614-20. doi: 10.1007/s00262-002-0328-9. Epub Oct. 18, 2002.
Tuorto et al., Genome recoding by tRNA modifications. Open Biol. Dec. 2016;6(12):160287. doi: 10.1098/rsob.160287.
Tycko et al., Methods for Optimizing CRISPR-Cas9 Genome Editing Specificity. Mol Cell. Aug. 4, 2016;63(3):355-70. doi: 10.1016/j.molcel.2016.07.004.
Umar et al., DNA loop repair by human cell extracts. Science. Nov. 4, 1994;266(5186):814-6. doi: 10.1126/science.7973637.
Valmori et al., Analysis of the cytolytic T lymphocyte response of melanoma patients to the naturally HLA-A*0201-associated tyrosinase peptide 368-376. Cancer Res. Aug. 15, 1999;59(16):4050-5.
Valmori et al., Enhanced generation of specific tumor-reactive CTL in vitro by selected Melan-A/MART-1 immunodominant peptide analogues. J Immunol. Feb. 15, 1998;160(4):1750-8.
Valmori et al., Naturally occurring human lymphocyte antigen-A2 restricted CD8+ T-cell response to the cancer testis antigen NY-ESO-1 in melanoma patients. Cancer Res. Aug. 15, 2000;60(16):4499-506.
Van Den Oord et al., Pixel Recurrent Neural Networks. Proceedings of the 33rd International Conference on Machine Learning. Journal of Machine Learning Research. Aug. 19, 2016. vol. 48. 11 pages.
Vidal et al., Yeast forward and reverse 'n'-hybrid systems. Nucleic Acids Res. Feb. 15, 1999;27(4):919-29. doi: 10.1093/nar/27.4.919.
Vigneron et al., A peptide derived from melanocytic protein gp100 and presented by HLA-B35 is recognized by autologous cytolytic T lymphocytes on melanoma cells. Tissue Antigens. Feb. 2005;65(2):156-62. doi: 10.1111/j.1399-0039.2005.00365.x.
Vigneron et al., An antigenic peptide produced by peptide splicing in the proteasome. Science. Apr. 23, 2004;304(5670):587-90. doi: 10.1126/science.1095522.
Visseren et al., Affinity, specificity and T-cell-receptor diversity of melanoma-specific CTL generated in vitro against a single tyrosinase epitope. Int J Cancer. Sep. 17, 1997;72(6):1122-8. doi: 10.1002/(sici)1097-0215(19970917)72:6<1122::aid-ijc30>3.0.co;2-3.
Voelkel et al., Protein transduction from retroviral Gag precursors. Proc Natl Acad Sci U S A. Apr. 27, 2010;107(17):7805-10. doi: 10.1073/pnas.0914517107. Epub Apr. 12, 2010.
Volpe et al., Alternative BCR/ABL splice variants in Philadelphia chromosome-positive leukemias result in novel tumor-specific fusion proteins that may represent potential targets for immunotherapy approaches. Cancer Res. Jun. 1, 2007;67(11):5300-7. doi: 10.1158/0008-5472.CAN-06-3737.
Voutev et al., Bxb1 phage recombinase assists genome engineering in *Drosophila melanogaster*. Biotechniques. Jan. 1, 2017;62(1):37-38. doi: 10.2144/000114494.
Walpita et al., Mammalian Cell-Derived Respiratory Syncytial Virus-Like Particles Protect the Lower as well as the Upper Respiratory Tract. PLoS One. Jul. 14, 2015;10(7):e0130755. doi: 10.1371/journal.pone.0130755.
Walton et al., Spontaneous CD8 T cell responses against the melanocyte differentiation antigen RAB38/NY-MEL-1 in melanoma patients. J Immunol. Dec. 1, 2006;177(11):8212-8. doi: 10.4049/jimmunol.177.11.8212.
Walton et al., Unconstrained genome targeting with near-PAMless engineered CRISPR-Cas9 variants. Science. Apr. 17, 2020;368(6488):290-296. doi: 10.1126/science.aba8853. Epub Mar. 26, 2020.
Wang et al., CRISPR/Cas9 in Genome Editing and Beyond. Annu Rev Biochem. Jun. 2, 2016;85:227-64. doi: 10.1146/annurev-biochem-060815-014607. Epub Apr. 25, 2016.
Wang et al., CRISPR-Based Therapeutic Genome Editing: Strategies and In Vivo Delivery by AAV Vectors. Cell. Apr. 2, 2020;181(1):136-150. doi: 10.1016/j.cell.2020.03.023.
Wang et al., Recognition of an antigenic peptide derived from tyrosinase-related protein-2 by CTL in the context of HLA-A31 and -A33. J Immunol. Jan. 15, 1998;160(2):890-7.
Wang et al., Recognition of breast cancer cells by CD8+ cytotoxic T-cell clones specific for NY-BR-1. Cancer Res. Jul. 1, 2006;66(13):6826-33. doi: 10.1158/0008-5472.CAN-05-3529.
Wang et al., Utilization of an alternative open reading frame of a normal gene in generating a novel human cancer antigen. J Exp Med. Mar. 1, 1996;183(3):1131-40. doi: 10.1084/jem.183.3.1131.
Wang et al., Virus-like particles for the prevention of human papillomavirus-associated malignancies. Expert Rev Vaccines. Feb. 2013;12(2):129-41. doi: 10.1586/erv.12.151. Author Manuscript, 22 pages.
Warren et al., Structure of the human MutSalpha DNA lesion recognition complex. Mol Cell. May 25, 2007;26(4):579-92. doi: 10.1016/j.molcel.2007.04.018.
Wei et al., Systemic nanoparticle delivery of CRISPR-Cas9 ribonucleoproteins for effective tissue specific genome editing. Nat Commun. Jun. 26, 2020;11(1):3232. doi: 10.1038/s41467-020-17029-3.
Wirth et al., Mildly affected patients with spinal muscular atrophy are partially protected by an increased SMN2 copy number Hum Genet. May 2006;119(4):422-8. doi: 10.1007/s00439-006-0156-7. Epub Mar. 1, 2006.
Witkowski et al., Conversion of a beta-ketoacyl synthase to a malonyl decarboxylase by replacement of the active-site cysteine with glutamine. Biochemistry. Sep. 7, 1999;38(36):11643- 50. doi: 10.1021/bi990993h.
Wölfel et al., Two tyrosinase nonapeptides recognized on HLA-A2 melanomas by autologous cytolytic T lymphocytes. Eur J Immunol. Mar. 1994;24(3):759-64. doi: 10.1002/eji.1830240340.
Woo et al., Gene activation of SMN by selective disruption of lncRNA-mediated recruitment of PRC2 for the treatment of spinal muscular atrophy. Proc Natl Acad Sci U S A. Feb. 21, 2017;114(8):E1509-E1518. doi:10.1073/pnas.1616521114. Epub Feb. 13, 2017.
Wu et al., A novel SCN9A mutation responsible for primary erythromelalgia and is resistant to the treatment of sodium channel blockers. PLoS One. 2013;8(1):e55212. doi: 10.1371/journal.pone.0055212. Epub Jan. 31, 2013. 15 pages.
Wu et al., MLV based viral-like-particles for delivery of toxic proteins and nuclear transcription factors. Biomaterials. Sep. 2014;35(29):8416-26. doi: 10.1016/j.biomaterials.2014.06.006. Epub Jul. 3, 2014.
Wu et al., Widespread Influence of 3'-End Structures on Mammalian mRNA Processing and Stability. Cell. May 18, 2017;169(5):905-917.e11. doi: 10.1016/j.cell.2017.04.036.

(56) References Cited

OTHER PUBLICATIONS

Xi et al., C-terminal Loop Mutations Determine Folding and Secretion Properties of PCSK9. Biochem Mol Biol J. 2016;2(3):17. doi: 10.21767/2471-8084.100026. 12 pages.
Yamane et al., Deep-sequencing identification of the genomic targets of the cytidine deaminase AID and its cofactor RPA in B lymphocytes. Nat Immunol. Jan. 2011;12(1):62-9. doi: 10.1038/ni.1964. Epub Nov. 28, 2010.
Yang et al., HIV-1 virus-like particles produced by stably transfected *Drosophila* S2 cells: a desirable vaccine component. J Virol. Jul. 2012;86(14):7662-76. doi: 10.1128/JVI.07164-11. Epub May 2, 2012.
Yao et al., Engineered extracellular vesicles as versatile ribonucleoprotein delivery vehicles for efficient and safe CRISPR genome editing. J Extracell Vesicles. Mar. 2021;10(5):e12076. doi: 10.1002/jev2.12076. Epub Mar. 16, 2021.
Yee et al., A general method for the generation of high-titer, pantropic retroviral vectors: highly efficient infection of primary hepatocytes. Proc Natl Acad Sci U S A. Sep. 27, 1994;91(20):9564-8. doi: 10.1073/pnas.91.20.9564.
Yi et al., Engineering of TEV protease variants by yeast ER sequestration screening (YESS) of combinatorial libraries. Proc Natl Acad Sci U S A. Apr. 30, 2013;110(18):7229-34. doi: 10.1073/pnas.1215994110. Epub Apr. 15, 2013.
Yin et al., Optimizing genome editing strategy by primer-extension-mediated sequencing. Cell Discov. Mar. 26, 2019;5:18. doi: 10.1038/s41421-019-0088-8.
Yu et al., Cytosine base editors with minimized unguided DNA and RNA off-target events and high on-target activity. Nat Commun. Apr. 28, 2020;11(1):2052. doi: 10.1038/s41467-020-15887-5.
Yu et al., Poor immunogenicity of a self/tumor antigen derives from peptide-MHC-I instability and is independent of tolerance. J Clin Invest. Aug. 2004;114(4):551-9. doi: 10.1172/JCI21695.
Zarour et al., Melan-A/MART-1(51-73) represents an immunogenic HLA-DR4-restricted epitope recognized by melanoma-reactive CD4(+) T cells. Proc Natl Acad Sci U S A. Jan. 4, 2000;97(1):400-5. doi: 10.1073/pnas.97.1.400.
Zeltins, A., Construction and characterization of virus-like particles: a review. Mol Biotechnol. Jan. 2013;53(1):92-107. doi: 10.1007/s12033-012-9598-4.
Zhang et al., Adenine Base Editing In Vivo with a Single Adeno-Associated Virus Vector. BioRxiv. Dec. 13, 2021. DOI: 10.1101/2021.12.13.472434. Retrieved from https://www.biorxiv.org/content/10.1101/2021.12.13.472434v1.full on Aug. 1, 2023. 47 pages.
Zhang et al., Cell-specific targeting of lentiviral vectors mediated by fusion proteins derived from Sindbis virus, vesicular stomatitis virus, or avian sarcoma/leukosis virus. Retrovirology. Jan. 25, 2010;7:3. doi: 10.1186/1742-4690-7-3.
Zhang et al., CRISPR-Cpf1 correction of muscular dystrophy mutations in human cardiomyocytes and mice. Sci Adv. Apr. 12, 2017;3(4):e1602814. doi: 10.1126/sciadv.1602814.
Zhang et al., Large genomic fragment deletions and insertions in mouse using CRISPR/Cas9. PLoS One. Mar. 24, 2015;10(3):e0120396. doi: 10.1371/journal.pone.0120396. 14 pages.
Zhang et al., Propagated Perturbations from a Peripheral Mutation Show Interactions Supporting WW Domain Thermostability. Structure. Nov. 6, 2018;26(11): 1474-1485.e5. doi: 10.1016/j.str.2018.07.014. Epub Sep. 6, 2018.
Zhang et al., Reconstitution of 5'-directed human mismatch repair in a purified system. Cell. Sep. 9, 2005;122(5):693-705. doi: 10.1016/j.cell.2005.06.027.
Zhao et al., Glycosylase base editors enable C-to-A and C-to-G base changes. Nat Biotechnol. Jan. 2021;39(1):35-40. doi: 10.1038/s41587-020-0592-2. Epub Jul. 20, 2020. Erratum in: Nat Biotechnol. Jan. 2021;39(1):115. doi: 10.1038/s41587-020-0648-3.
Zhao et al., Study on p21 gene knock out in G401 cell line by using CRISPR/Cas9 system. Tianjin Med J. Oct. 2016;44(10):1190-1194.
Zhi et al., Dual-AAV delivering split prime editor system for in vivo genome editing. Mol Ther. Jan. 5, 2022;30(1):283-294 and Supplemental Info. doi: 10.1016/j.ymthe.2021.07.011. Epub Jul. 21, 2021. 35 pages.
Zhu et al., Novel Thrombotic Function of a Human SNP in STXBP5 Revealed by CRISPR/Cas9 Gene Editing in Mice. Arterioscler Thromb Vasc Biol. Feb. 2017;37(2):264-270. doi: 10.1161/ATVBAHA.116.308614. Epub Dec. 29, 2016.
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 61/838,178, filed Jun. 21, 2013, Joung et al.
U.S. Appl. No. 61/874,682, filed Sep. 6, 2013, Liu et al.
U.S. Appl. No. 61/874,746, filed Sep. 6, 2013, Liu et al.
U.S. Appl. No. 62/288,661, filed Jan. 29, 2016, Muir et al.
U.S. Appl. No. 62/357,332, filed Jun. 30, 2016, Liu et al.
International Search Report and Written Opinion, mailed Jul. 24, 2020, in connection with Application No. PCT/US2020/028568.
International Preliminary Report on Patentability, mailed Oct. 28, 2021, in connection with Application No. PCT/US2020/028568.
[No Author Listed] "FokI" from New England Biolabs Inc. Last accessed online via https://www.neb.com/products/r0109-foki#Product%20Information on Mar. 19, 2021. 1 page.
[No Author Listed] "Nucleic Acids Sizes and Molecular Weights." Printed Mar. 19, 2021. 2 pages.
[No Author Listed] "Zinc Finger Nuclease" from Wikipedia. Retrieved from https://en.wikipedia.org/w/index.php?title=Zinc_finger_nuclease&oldid=1007053318. Page last edited Feb. 16, 2021. Printed on Mar. 19, 2021.
[No Author Listed] Beast2: Bayesian evolutionary analysis by sampling trees. http://www.beast2.org/ Last accessed Apr. 28, 2021.
[No Author Listed] HyPhy—Hypothesis testing using Phylogenies. Last modified Apr. 21, 2017. Accessed online via http://hyphy.org/w/index.php/Main_Page on Apr. 28, 2021.
[No Author Listed] NCBI Accession No. XP_015843220.1. C ->U editing enzyme APOBEC-1 [Peromyscus maniculatus bairdii], XP002793540. Mar. 21, 2016.
[No Author Listed] NCBI Accession No. XP_021505673.1. C ->U editing enzyme APOBEC-1 [Meriones unguiculatus], XP002793541. Jun. 27, 2017.
[No Author Listed] NCBI Reference Sequence: WP_00087959824.1. Oct. 9, 2019. 2 pages.
[No Author Listed] NCBI Reference Sequence: WP_001516895.1. Mar. 13, 2021. 2 pages.
[No Author Listed] Nucleic Acid Data from New England Biolabs. Printed Sep. 28, 2021. 1 page.
[No Author Listed] Score result for SEQ 355 to W02017032580. Muir et al. 2016.
[No Author Listed] Theoretical Biochemistry Group. Institute for Theoretical Chemistry. The ViennaRNA Package. Universitat Wien. https://www.tbi.univie.ac.at/RNA/. Last accessed Apr. 28, 2021.
[No Author Listed] Transcription activator-like effector nuclease. Wikipedia. Last edited Sep. 27, 2021. Accessed via https://en.wikipedia.org/w/index.php?title=Transcription_activator-like_effector_nuclease&oldid=1046813325 on Sep. 28, 2021. 9 pages.
[No Author Listed], "Human genome." Encyclopedia Britannica. Encyclopedia Brittanica, Inc. Published Feb. 15, 2019. Last accessed online via https://www.britannica.com/science/human-genome on Mar. 19, 2021. 2 pages.
[No Author Listed], EMBL Accession No. Q99ZW2. Nov. 2012. 2 pages.
[No Author Listed], Invitrogen Lipofectamine™ 2000 product sheets, 2002. 2 pages.
[No Author Listed], Invitrogen Lipofectamine™ 2000 product sheets, 2005. 3 pages.
[No Author Listed], Invitrogen Lipofectamine™ LTX product sheets, 2011. 4 pages.

(56) References Cited

OTHER PUBLICATIONS

[No Author Listed], Mus musculus (Mouse). UniProtKB Accession No. P51908 (ABEC1_MOUSE). Oct. 1, 1996. 10 pages.
[No Author Listed], Thermo Fisher Scientific—How Cationic Lipid Mediated Transfection Works, retrieved from the internet Aug. 27, 2015. 2 pages.
Abremski et al., Bacteriophage P1 site-specific recombination. Purification and properties of the Cre recombinase protein. J Biol Chem. Feb. 10, 1984;259(3):1509-14.
Abudayyeh et al., C2c2 is a single-component programmable RNA-guided RNA-targeting CRISPR effector. Science Aug. 2016;353(6299):aaf5573. DOI: 10.1126/science.aaf5573.
Abudayyeh et al., A cytosine deaminase for programmable single-base RNA editing. Science. Jul. 26, 2019;365(6451):382-386. doi: 10.1126/science.aax7063. Epub Jul. 11, 2019.
Abudayyeh et al., RNA targeting with CRISPR-Cas13. Nature. Oct. 12, 2017;550(7675):280-284. doi: 10.1038/nature24049. Epub Oct. 4, 2017.
Ada et al., Carbohydrate-protein conjugate vaccines. Clin Microbiol Infect. Feb. 2003;9(2):79-85. doi: 10.1046/j.1469-0691.2003.00530.x.
Adamala et al., Programmable RNA-binding protein composed of repeats of a single modular unit. Proc Natl Acad Sci U S A. May 10, 2016;113(19):E2579-88. doi: 10.1073/pnas.1519368113. Epub Apr. 26, 2016.
Adams et al., New biarsenical ligands and tetracysteine motifs for protein labeling in vitro and in vivo: synthesis and biological applications. J Am Chem Soc. May 29, 2002;124(21):6063-76. doi: 10.1021/ja017687n.
Addgene Plasmid # 44246. pdCas9-humanized, 2017, Stanley Qi.
Addgene Plasmid # 73021. PCMV-BE3, 2017, David Liu.
Addgene Plasmid # 79620. pcDNA3.1_pCMV-nCas-PmCDA1-ugi pH1-gRNA(HPRT), 2017, Akihiko Kondo.
Adli, The CRISPR tool kit for genome editing and beyond. Nat Commun. May 15, 2018;9(1):1911. doi: 10.1038/s41467-018-04252-2.
Aguilo et al., Coordination of m(6)A mRNA Methylation and Gene Transcription by ZFP217 Regulates Pluripotency and Reprogramming. Cell Stem Cell. Dec. 3, 2015;17(6):689-704. doi: 10.1016/j.stem.2015.09.005. Epub Oct. 29, 2015.
Ahmad et al., Antibody-mediated specific binding and cytotoxicity of liposome-entrapped doxorubicin to lung cancer cells in vitro. Cancer Res. Sep. 1, 1992;52(17):4817-20.
Aida et al., Prime editing primarily incudes undesired outcomes in mice. bioRxiv preprint and Supplemental Information. Aug. 6, 2020. Retrieved from www.biorxiv.org. doi: 10.1101/2020.08.06.239723. 40 pages.
Aihara et al., A conformational switch controls the DNA cleavage activity of lambda integrase. Mol Cell. Jul. 2003;12(1):187-98.
Aik et al., Structure of human RNA ?-methyladenine demethylase ALKBH5 provides insights into its mechanisms of nucleic acid recognition and demethylation. Nucleic Acids Res. Apr. 2014;42(7):4741-54. doi: 10.1093/nar/gku085. Epub Jan. 30, 2014.
Aird et al., Increasing Cas9-mediated homology-directed repair efficiency through covalent tethering of DNA repair template. Commun Biol. May 31, 2018;1:54. doi: 10.1038/s42003-018-0054-2.
Akcakaya et al., In vivo CRISPR editing with no detectable genome-wide off-target mutations. Nature. Sep. 2018;561(7723):416-419. doi: 10.1038/s41586-018-0500-9. Epub Sep. 12, 2018. PMID: 30209390; PMCID: PMC6194229.
Akins et al., Mitochondrial plasmids of Neurospora: integration into mitochondrial DNA and evidence for reverse transcription in mitochondria. Cell. Nov. 21, 1986;47(4):505-16. doi: 10.1016/0092-8674(86)90615-x.
Akinsheye et al., Fetal hemoglobin in sickle cell anemia. Blood. Jul. 7, 2011;118(1):19-27. doi: 10.1182/blood-2011-03-325258. Epub Apr. 13, 2011.
Akopian et al., Chimeric recombinases with designed DNA sequence recognition. Proc Natl Acad Sci U S A. Jul. 22, 2003;100(15):8688-91. Epub Jul. 1, 2003.
Alarcón et al., HNRNPA2B1 Is a Mediator of m(6)A-Dependent Nuclear RNA Processing Events. Cell. Sep. 10, 2015;162(6):1299-308. doi: 10.1016/j.cell.2015.08.011. Epub Aug. 27, 2015.
Alarcón et al., N6-methyladenosine marks primary microRNAs for processing. Nature. Mar. 26, 2015;519(7544):482-5. doi: 10.1038/nature14281. Epub Mar. 18, 2015.
Alexander, HFE-associated hereditary hemochromatosis. Genet Med. May 2009;11(5):307-13. doi: 10.1097/GIM.0b013e31819d30f2.
Alexandrov et al., Signatures of mutational processes in human cancer. Nature. Aug. 22, 2013;500(7463):415-21. doi: 10.1038/nature12477. Epub Aug. 14, 2013.
Ali et al., Novel genetic abnormalities in Bernard-Soulier syndrome in India. Ann Hematol. Mar. 2014;93(3):381-4. doi: 10.1007/s00277-013-1895-x. Epub Sep. 1, 2013.
Altschul et al., Basic local alignment search tool. J Mol Biol. Oct. 5, 1990;215(3):403-10. doi: 10.1016/S0022-2836(05)80360-2.
Amato et al., Interpreting elevated fetal hemoglobin in pathology and health at the basic laboratory level: new and known γ-gene mutations associated with hereditary persistence of fetal hemoglobin. Int J Lab Hematol. Feb. 2014;36(1):13-9. doi: 10.1111/ijlh.12094. Epub Apr. 29, 2013.
Ames et al., A eubacterial riboswitch class that senses the coenzyme tetrahydrofolate. Chem Biol. Jul. 30, 2010;17(7):681-5. doi: 10.1016/j.chembiol.2010.05.020.
Amrann et al., Tightly regulated tac promoter vectors useful for the expression of unfused and fused proteins in *Escherichia coli*. Gene. Sep. 30, 1988;69(2):301-15.
Anders et al., Chapter One: In Vitro Enzymology of Cas9. in Methods in Enzymology, eds Doudna et al. 2014: 546:1-20.
Anders et al., Structural basis of PAM-dependent target DNA recognition by the Cas9 endonuclease. Nature. Sep. 25, 2014;513(7519):569-73. doi: 10.1038/nature13579. Epub Jul. 27, 2014.
Anderson, Human gene therapy. Science. May 8, 1992;256(5058):808-13. doi: 10.1126/science.1589762.
André et al., Axotomy-induced expression of calcium-activated chloride current in subpopulations of mouse dorsal root ganglion neurons. J Neurophysiol. Dec. 2003;90(6):3764-73. doi: 10.1152/jn.00449.2003. Epub Aug. 27, 2003.
Anzalone et al., Genome editing with CRISPR-Cas nucleases, base editors, transposases and prime editors. Nat Biotechnol. Jul. 2020;38(7):824-844. doi: 10.1038/s41587-020-0561-9. Epub Jun. 22, 2020.
Anzalone et al., Reprogramming eukaryotic translation with ligand-responsive synthetic RNA switches. Nat Methods. May 2016;13(5):453-8. doi: 10.1038/nmeth.3807. Epub Mar. 21, 2016.
Anzalone et al., Search-and-replace genome editing without double-strand breaks or donor DNA. Nature. Dec. 2019;576(7785):149-157. doi: 10.1038/s41586-019-1711-4. Epub Oct. 21, 2019.
Aplan, Causes of oncogenic chromosomal translocation. Trends Genet. Jan. 2006;22(1):46-55. doi: 10.1016/j.tig.2005.10.002. Epub Oct. 28, 2005.
Arakawa et al., A method to convert mRNA into a gRNA library for CRISPR/Cas9 editing of any organism. Sci Adv. Aug. 24, 2016;2(8):e1600699. doi: 10.1126/sciadv.1600699.
Araki et al., Comparative analysis of right element mutant lox sites on recombination efficiency in embryonic stem cells. BMC Biotechnol. Mar. 31, 2010;10:29. doi: 10.1186/1472-6750-10-29.
Araki et al., Site-specific recombinase, R, encoded by yeast plasmid pSR1. J Mol Biol. May 5, 1992;225(1):25-37. doi: 10.1016/0022-2836(92)91023-i.
Araki et al., Targeted integration of DNA using mutant lox sites in embryonic stem cells. Nucleic Acids Res. Feb. 15, 1997;25(4):868-72. doi: 10.1093/nar/25.4.868.
Arambula et al., Surface display of a massively variable lipoprotein by a Legionella diversity-generating retroelement. Proc Natl Acad Sci U S A. May 14, 2013;110(20):8212-7. doi: 10.1073/pnas.1301366110. Epub Apr. 30, 2013.

(56) References Cited

OTHER PUBLICATIONS

Arazoe et al., Targeted Nucleotide Editing Technologies for Microbial Metabolic Engineering. Biotechnol J. Sep. 2018;13(9):e1700596. doi: 10.1002/biot.201700596. Epub Jun. 19, 2018.
Arbab et al., Cloning-free CRISPR. Stem Cell Reports. Nov. 10, 2015;5(5):908-917. doi: 10.1016/j.stemcr.2015.09.022. Epub Oct. 29, 2015.
Arbab et al., Determinants of Base Editing Outcomes from Target Library Analysis and Machine Learning. Cell. Jul. 23, 2020;182(2):463-480.e30. doi: 10.1016/j.cell.2020.05.037. Epub Jun. 12, 2020.
Arezi et al., Novel mutations in Moloney Murine Leukemia Virus reverse transcriptase increase thermostability through tighter binding to template-primer. Nucleic Acids Res. Feb. 2009;37(2):473-81. doi: 10.1093/nar/gkn952. Epub Dec. 4, 2008.
Arnold et al., Mutants of Tn3 resolvase which do not require accessory binding sites for recombination activity. EMBO J. Mar. 1, 1999;18(5):1407-14.
Asante et al., A naturally occurring variant of the human prion protein completely prevents prion disease. Nature. Jun. 25, 2015;522(7557):478-81. doi: 10.1038/nature14510. Epub Jun. 10, 2015.
Asokan et al., The AAV vector toolkit: poised at the clinical crossroads. Mol Ther. Apr. 2012;20(4):699-708. doi: 10.1038/mt.2011.287. Epub Jan. 24, 2012.
Atkins et al., Ribosomal frameshifting and transcriptional slippage: From genetic steganography and cryptography to adventitious use. Nucleic Acids Res. Sep. 6, 2016;44(15):7007-78. doi: 10.1093/nar/gkw530. Epub Jul. 19, 2016.
Auer et al., Highly efficient CRISPR/Cas9-mediated knock-in in zebrafish by homology-independent DNA repair. Genome Res. Jan. 2014;24(1):142-53. doi: 10.1101/gr.161638.113. Epub Oct. 31, 2013.
Auricchio et al., Exchange of surface proteins impacts on viral vector cellular specificity and transduction characteristics: the retina as a model. Hum Mol Genet. Dec. 15, 2001;10(26):3075-81. doi: 10.1093/hmg/10.26.3075.
Autieri et al., IRT-1, a novel interferon-gamma-responsive transcript encoding a growth-suppressing basic leucine zipper protein. J Biol Chem. Jun. 12, 1998;273(24):14731-7. doi: 10.1074/jbc.273.24.14731.
Avidan et al., The processivity and fidelity of DNA synthesis exhibited by the reverse transcriptase of bovine leukemia virus. Eur J Biochem. Feb. 2002;269(3):859-67. doi: 10.1046/j.0014-2956.2001.02719.x.
Babacic et al., CRISPR-cas gene-editing as plausible treatment of neuromuscular and nucleotide-repeat-expansion diseases: A systematic review. PLoS One. Feb. 22, 2019;14(2):e0212198. doi: 10.1371/journal.pone.0212198.
Bacman et al., Specific elimination of mutant mitochondrial genomes in patient-derived cells by mitoTALENs. Nat Med. Sep. 2013;19(9):1111-3. doi: 10.1038/nm.3261. Epub Aug. 4, 2013.
Badran et al., Continuous evolution of Bacillus thuringiensis toxins overcomes insect resistance. Nature. May 5, 2016;533(7601):58-63. doi: 10.1038/nature17938. Epub Apr. 27, 20167.
Badran et al., Development of potent in vivo mutagenesis plasmids with broad mutational spectra. Nat Commun. Oct. 7, 2015;6:8425. doi: 10.1038/ncomms9425.
Badran et al., In vivo continuous directed evolution. Curr Opin Chem Biol. Feb. 2015;24:1-10. doi: 10.1016/j.cbpa.2014.09.040. Epub Nov. 7, 2014.
Bae et al., Cas-OFFinder: a fast and versatile algorithm that searches for potential off-target sites of Cas9 RNA-guided endonucleases. Bioinformatics. May 15, 2014;30(10):1473-5. doi: 10.1093/bioinformatics/btu048. Epub Jan. 24, 2014.
Bae et al., Microhomology-based choice of Cas9 nuclease target sites. Nat Methods. Jul. 2014;11(7):705-6. doi: 10.1038/nmeth.3015.
Bagal et al., Recent progress in sodium channel modulators for pain. Bioorg Med Chem Lett. Aug. 15, 2014;24(16):3690-9. doi: 10.1016/j.bmcl.2014.06.038. Epub Jun. 21, 2014.
Bagyinszky et al., Characterization of mutations in PRNP (prion) gene and their possible roles in neurodegenerative diseases. Neuropsychiatr Dis Treat. Aug. 14, 2018;14:2067-2085. doi: 10.2147/NDT.S165445.
Balakrishnan et al., Flap endonuclease 1. Annu Rev Biochem. 2013;82:119-38. doi: 10.1146/annurev-biochem-072511-122603. Epub Feb. 28, 2013.
Baldari et al., A novel leader peptide which allows efficient secretion of a fragment of human interleukin 1 beta in *Saccharomyces cerevisiae*. EMBO J. Jan. 1987;6(1):229-34.
Banerjee et al., Cadmium inhibits mismatch repair by blocking the ATPase activity of the MSH2-MSH6 complex [published correction appears in Nucleic Acids Res. 2005;33(5):1738]. Nucleic Acids Res. 2005;33(4):1410-1419. Published Mar. 3, 2005. doi: 10.1093/nar/gki291.
Banerji et al., A lymphocyte-specific cellular enhancer is located downstream of the joining region in immunoglobulin heavy chain genes. Cell. Jul. 1983;33(3):729-40. doi: 10.1016/0092-8674(83)90015-6.
Bannert et al., Retroelements and the human genome: new perspectives on an old relation. Proc Natl Acad Sci U S A. Oct. 5, 2004;101 Suppl 2(Suppl 2):14572-9. doi: 10.1073/pnas.0404838101. Epub Aug. 13, 2004.
Banno et al., Deaminase-mediated multiplex genome editing in *Escherichia coli*. Nat Microbiol. Apr. 2018;3(4):423-429. doi: 10.1038/s41564-017-0102-6. Epub Feb. 5, 2018.
Baranauskas et al., Generation and characterization of new highly thermostable and processive M-MuLV reverse transcriptase variants. Protein Eng Des Sel. Oct. 2012;25(10):657-68. doi: 10.1093/protein/gzs034. Epub Jun. 12, 2012.
Barmania et al., C-C chemokine receptor type five (CCR5): An emerging target for the control of HIV infection. Appl Transl Genom. May 26, 2013;2:3-16. doi: 10.1016/j.atg.2013.05.004.
Barnes et al., Repair and genetic consequences of endogenous DNA base damage in mammalian cells. Annu Rev Genet. 2004;38:445-76.
Barnes et al., The fidelity of Taq polymerase catalyzing PCR is improved by an -terminal deletion. Gene. Mar. 1, 1992;112(1):29-35. doi: 10.1016/0378-1119(92)90299-5.
Barrangou et al., CRISPR provides acquired resistance against viruses in prokaryotes. Science. Mar. 23, 2007;315(5819):1709-12.
Barrangou, RNA-mediated programmable DNA cleavage. Nat Biotechnol. Sep. 2012;30(9):836-8. doi: 10.1038/nbt.2357.
Bartlett et al., Efficient expression of protein coding genes from the murine U1 small nuclear RNA promoters. Proc Natl Acad Sci U S A. Aug. 20, 1996;93(17):8852-7. doi: 10.1073/pnas.93.17.8852.
Bartosovic et al., N6-methyladenosine demethylase FTO targets pre-mRNAs and regulates alternative splicing and 3'-end processing. Nucleic Acids Res. Nov. 2, 2017;45(19):11356-11370. doi: 10.1093/nar/gkx778.
Basha et al., Influence of cationic lipid composition on gene silencing properties of lipid nanoparticle formulations of siRNA in antigen-presenting cells. Mol Ther. Dec. 2011;19(12):2186-200. doi: 10.1038/mt.2011.190. Epub Oct. 4, 2011.
Bass, B.L., RNA editing by adenosine deaminases that act on RNA. Annu Rev Biochem. 2002;71:817-46. doi: 10.1146/annurev.biochem.71.110601.135501. Epub Nov. 9, 2001.
Basturea et al., Substrate specificity and properties of the *Escherichia coli* 16S rRNA methyltransferase, RsmE. RNA. Nov. 2007;13(11):1969-76. doi: 10.1261/rna.700507. Epub Sep. 13, 2007.
Batey et al., Structure of a natural guanine-responsive riboswitch complexed with the metabolite hypoxanthine. Nature. Nov. 18, 2004;432(7015):411-5.
Beale et al., Comparison of the differential context-dependence of DNA deamination by APOBEC enzymes: correlation with mutation spectra in vivo. J Mol Biol. Mar. 26, 2004;337(3):585-96.
Beaudry et al., Directed evolution of an RNA enzyme. Science. Jul. 31, 1992;257(5070):635-41. doi: 10.1126/science.1496376.
Bebenek et al., Error-prone polymerization by HIV-1 reverse transcriptase. Contribution of template-primer misalignment, miscoding, and termination probability to mutational hot spots. J Biol Chem. May 15, 1993;268(14):10324-34.

(56) References Cited

OTHER PUBLICATIONS

Bedell et al., In vivo genome editing using a high-efficiency TALEN system. Nature. Nov. 1, 2012;491(7422):114-8. Doi: 10.1038/nature11537. Epub Sep. 23, 2012.
Begley, Scientists unveil the 'most clever CRISPR gadget' so far. STAT, Apr. 20, 2016. https://www.statnews.com/2016/04/20/clever-crispr-advance-unveiled/.
Behr, Gene transfer with synthetic cationic amphiphiles: prospects for gene therapy. Bioconjug Chem. Sep.-Oct. 1994;5(5):382-9. doi: 10.1021/bc00029a002.
Bell et al., Ribozyme-catalyzed excision of targeted sequences from within RNAs. Biochemistry. Dec. 24, 2002;41(51):15327-33. doi: 10.1021/bi0267386.
Belshaw et al., Controlling programmed cell death with a cyclophilin-cyclosporin-based chemical inducer of dimerization. Chem Biol. Sep. 1996;3(9):731-8. doi: 10.1016/s1074-5521(96)90249-5.
Belshaw et al., Controlling protein association and subcellular localization with a synthetic ligand that induces heterodimerization of proteins. Proc Natl Acad Sci U S A. May 14, 1996;93(10):4604-7. doi: 10.1073/pnas.93.10.4604.
Benarroch, HCN channels: function and clinical implications. Neurology. Jan. 15, 2013;80(3):304-10. doi: 10.1212/WNL.0b013e31827dec42.
Bennett et al., Painful and painless channelopathies. Lancet Neurol. Jun. 2014;13(6):587-99. doi: 10.1016/S1474-4422(14)70024-9. Epub May 6, 2014.
Bentin, T., A ribozyme transcribed by a ribozyme. Artif DNA PNA XNA. Apr. 2011;2(2):40-42. doi: 10.4161/adna.2.2.16852.
Berger et al., Reverse transcriptase and its associated ribonuclease H: interplay of two enzyme activities controls the yield of single-stranded complementary deoxyribonucleic acid. Biochemistry. May 10, 1983;22(10):2365-72. doi: 10.1021/bi00279a010.
Berges et al., Transduction of brain by herpes simplex virus vectors. Mol Ther. Jan. 2007;15(1):20-9. doi: 10.1038/sj.mt.6300018.
Berkhout et al., Identification of an active reverse transcriptase enzyme encoded by a human endogenous HERV-K retrovirus. J Virol. Mar. 1999;73(3):2365-75. doi: 10.1128/JVI.73.3.2365-2375.1999.
Bernhart et al., Local RNA base pairing probabilities in large sequences. Bioinformatics. Mar. 1, 2006;22(5):614-5. doi: 10.1093/bioinformatics/btk014. Epub Dec. 20, 2005.
Bernstein et al., Role for a bidentate ribonuclease in the initiation step of RNA interference. Nature. Jan. 18, 2001;409(6818):363-6. doi: 10.1038/35053110.
Bershtein et al., Advances in laboratory evolution of enzymes. Curr Opin; Chem Biol. Apr. 2008;12(2):151-8. doi: 10.1016/j.cbpa.2008.01.027. Epub Mar. 7, 2008. Review.
Bertolotti et al., Toward genosafe endonuclease-boosted gene targeting using breakthrough CRISP/Cas9 for next generation stem cell gene therapy culminating in efficient ex Vivo in Vivo gene repair/genomic editing. Molecular Therapy. May 2015;23(Suppl1):S139. Abstract 350. 18th Ann Meeting of the American Society of Gene and Cell Therapy. ASGCT 2015. New Orleans, LA. May 13, 2015-May 16, 2015.
Bertrand et al., Localization of ASHI mRNA particles in living yeast. Mol Cell. Oct. 1998;2(4):437-45. doi: 10.1016/s1097-2765(00)80143-4.
Bessen et al., High-resolution specificity profiling and off-target prediction for site-specific DNA recombinases. Nat Commun. Apr. 26, 2019;10(1):1937. doi: 10.1038/s41467-019-09987-0.
Beumer et al., Efficient gene targeting in *Drosophila* with zinc-finger nucleases. Genetics. Apr. 2006; 172(4):2391-403. Epub Feb. 1, 2006.
Bhagwat, DNA-cytosine deaminases: from antibody maturation to antiviral defense. DNA Repair (Amst). Jan. 5, 2004;3(1):85-9.
Bi et al., Pseudo attP sites in favor of transgene integration and expression in cultured porcine cells identified by Streptomyces phage phiC31 integrase. BMC Mol Biol. Sep. 8, 2013;14:20. doi: 10.1186/1471-2199-14-20.
Bibb et al., Integration and excision by the large serine recombinase phiRv1 integrase. Mol Microbiol. Mar. 2005;55(6):1896-910. doi: 10.1111/j.1365-2958.2005.04517.x.
Biehs et al., DNA Double-Strand Break Resection Occurs during Non-homologous End Joining in G1 but Is Distinct from Resection during Homologous Recombination. Mol Cell. Feb. 16, 2017;65(4):671-684.e5. doi: 10.1016/j.molcel.2016.12.016. Epub Jan. 26, 2017.
Billon et al., CRISPR-Mediated Base Editing Enables Efficient Disruption of Eukaryotic Genes through Induction of STOP Codons. Mol Cell. Sep. 21, 2017;67(6):1068-1079.e4. doi: 10.1016/j.molcel.2017.08.008. Epub Sep. 7, 2017.
Birling et al., Site-specific recombinases for manipulation of the mouse genome. Methods Mol Biol. 2009;561:245-63. doi: 10.1007/978-1-60327-019-9_16.
Biswas et al., A structural basis for allosteric control of DNA recombination by lambda integrase. Nature. Jun. 23, 2005;435(7045):1059-66. doi: 10.1038/nature03657.
Bitinaite et al., FokI dimerization is required for DNA cleavage. Proc Natl Acad Sci U S A. Sep. 1, 1998;95(18):10570-5.
Blaese et al., Vectors in cancer therapy: how will they deliver? Cancer Gene Ther. Dec. 1995;2(4):291-7.
Blain et al., Nuclease activities of Moloney murine leukemia virus reverse transcriptase. Mutants with altered substrate specificities. J Biol Chem. Nov. 5, 1993;268(31):23585-92.
Blaisonneau et al., A circular plasmid from the yeast Torulaspora delbrueckii. Plasmid. 1997;38(3):202-9. doi: 10.1006/plas.1997.1315.
Blau et al., A proliferation switch for genetically modified cells. PNAS Apr. 1, 1997 94 (7) 3076-3081; https://doi.org/10.1073/pnas.94.7.3076.
Bloom et al., Evolving strategies for enzyme engineering. Curr Opin Struct Biol. Aug. 2005;15(4):447-52.
Boch, TALEs of genome targeting. Nat Biotechnol. Feb. 2011;29(2):135-6. Doi: 10.1038/nbt.1767.
Bodi et al., Yeast m6A Methylated mRNAs Are Enriched on Translating Ribosomes during Meiosis, and under Rapamycin Treatment. PLoS One. Jul. 17, 2015;10(7):e0132090. doi: 10.1371/journal.pone.0132090.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Boersma et al., Selection strategies for improved biocatalysts. FEBS J. May 2007;274(9):2181-95.
Bogdanove et al., Engineering altered protein-DNA recognition specificity. Nucleic Acids Res. Jun. 1, 2018;46(10):4845-4871. doi: 10.1093/nar/gky289.
Bogdanove et al., TAL effectors: customizable proteins for DNA targeting. Science. Sep. 30, 2011;333(6051):1843-6. doi: 10.1126/science.1204094.
Bohlke et al., Sense codon emancipation for proteome-wide incorporation of noncanonical amino acids: rare isoleucine codon AUA as a target for genetic code expansion. FEMS Microbiol Lett. Feb. 2014;351(2):133-44. doi: 10.1111/1574-6968.12371. Epub Jan. 27, 2014.
Bolotin et al., Clustered regularly interspaced short palindrome repeats (CRISPRs) have spacers of extrachromosomal origin. Microbiology. Aug. 2005;151(Pt 8):2551-61.
Bolusani et al., Evolution of variants of yeast site-specific recombinase Flp that utilize native genomic sequences as recombination target sites. Nucleic Acids Res. 2006;34(18):5259-69. Epub Sep. 26, 2006.
Bondeson et al., Inversion of the IDS gene resulting from recombination with IDS-related sequences is a common cause of the Hunter syndrome. Hum Mol Genet. Apr. 1995;4(4):615-21. doi: 10.1093/hmg/4.4.615.
Borchardt et al., Controlling mRNA stability and translation with the CRISPR endoribonuclease Csy4. RNA. Nov. 2015;21(11):1921-30. doi: 10.1261/rna.051227.115. Epub Sep. 9, 2015.
Borman, Improved route to single-base genome editing. Chemical & Engineering News, Apr. 25, 2016;94(17)p5. http://cen.acs.org/articles/94/i17/Improved-route-single-base-genome.html.

(56) References Cited

OTHER PUBLICATIONS

Bothmer et al., Characterization of the interplay between DNA repair and CRISPR/Cas9-induced DNA lesions at an endogenous locus. Nat Commun. Jan. 9, 2017;8:13905. doi: 10.1038/ncomms13905.
Bourinet et al., Silencing of the Cav3.2 T-type calcium channel gene in sensory neurons demonstrates its major role in nociception. EMBO J. Jan. 26, 2005;24(2):315-24. doi: 10.1038/sj.emboj.7600515. Epub Dec. 16, 2004.
Boutabout et al., DNA synthesis fidelity by the reverse transcriptase of the yeast retrotransposon Ty1. Nucleic Acids Res. Jun. 1, 2001;29(11):2217-22. doi: 10.1093/nar/29.11.2217.
Box et al., A multi-domain protein system based on the HC fragment of tetanus toxin for targeting DNA to neuronal cells. J Drug Target. Jul. 2003;11(6):333-43. doi: 10.1080/10611863100001634667.
Branden and Tooze, Introduction to Protein Structure. 1999; 2nd edition. Garland Science Publisher: 3-12.
Braun et al., Immunogenic duplex nucleic acids are nuclease resistant. J Immunol. Sep. 15, 1988;141(6):2084-9.
Brierley et al., Viral RNA pseudoknots: versatile motifs in gene expression and replication. Nat Rev Microbiol. Aug. 2007;5(8):598-610. doi: 10.1038/nrmicro1704.
Briner et al., Guide RNA functional modules direct Cas9 activity and orthogonality. Mol Cell. Oct. 23, 2014;56(2):333-339. doi: 10.1016/j.molcel.2014.09.019.
Britt et al., Re-engineering plant gene targeting. Trends Plant Sci. Feb. 2003;8(2):90-5.
Brouns et al., Small CRISPR RNAs guide antiviral defense in prokaryotes. Science. Aug. 15, 2008;321(5891):960-4. doi: 10.1126/science.1159689.
Brown et al., A mammalian protein targeted by G1-arresting rapamycin-receptor complex. Nature. Jun. 30, 1994;369(6483):756-8. doi: 10.1038/369756a0.
Brown et al., Characterization of the genetic elements required for site-specific integration of plasmid pSE211 in Saccharopolyspora erythraea. J Bacteriol. Apr. 1990;172(4):1877-88. doi: 10.1128/jb.172.4.1877-1888.1990.
Brown et al., Serine recombinases as tools for genome engineering. Methods. Apr. 2011;53(4):372-9. doi: 10.1016/j.ymeth.2010.12.031. Epub Dec. 30, 2010.
Brown et al., Structural insights into the stabilization of MALAT1 noncoding RNA by a bipartite triple helix. Nat Struct Mol Biol. Jul. 2014;21(7):633-40. doi: 10.1038/nsmb.2844. Epub Jun. 22, 2014.
Brusse et al., Spinocerebellar ataxia associated with a mutation in the fibroblast growth factor 14 gene (SCA27): A new phenotype. Mov Disord. Mar. 2006;21(3):396-401.
Brzezicha et al., Identification of human tRNA:m5C methyltransferase catalysing intron-dependent m5C formation in the first position of the anticodon of the pre-tRNA Leu (CAA). Nucleic Acids Res. 2006;34(20):6034-43. doi: 10.1093/nar/gkl765. Epub Oct. 27, 2006.
Buchholz et al., Alteration of Cre recombinase site specificity by substrate-linked protein evolution. Nat Biotechnol. Nov. 2001;19(11):1047-52.
Buchschacher et al., Human immunodeficiency virus vectors for inducible expression of foreign genes. J Virol. May 1992;66(5):2731-9. doi: 10.1128/JVI.66.5.2731-2739.1992.
Buchwald et al., Long-term, continuous intravenous heparin administration by an implantable infusion pump in ambulatory patients with recurrent venous thrombosis. Surgery. Oct. 1980;88(4):507-16.
Buckley et al., Targeting the von Hippel-Lindau E3 ubiquitin ligase using small molecules to disrupt the VHL/HIF-1? interaction. J Am Chem Soc. Mar. 14, 2012;134(10):4465-8. doi: 10.1021/ja209924v. Epub Feb. 27, 2012.
Budisa et al., Residue-specific bioincorporation of non-natural, biologically active amino acids into proteins as possible drug carriers: structure and stability of the per-thiaproline mutant of annexin V. Proc Natl Acad Sci U S A. Jan. 20, 1998;95(2):455-9.
Budker et al., Protein/amphipathic polyamine complexes enable highly efficient transfection with minimal toxicity. Biotechniques. Jul. 1997;23(1):139, 142-7. doi: 10.2144/97231rr02.
Budworth et al., A brief history of triplet repeat diseases. Methods Mol Biol. 2013; 1010:3-17. doi: 10.1007/978-1-62703-411-1_1.
Bulow et al., Multienzyme systems obtained by gene fusion. Trends Biotechnol. Jul. 1991;9(7):226-31.
Burke et al., Activating mutations of Tn3 resolvase marking interfaces important in recombination catalysis and its regulation. Mol Microbiol. Feb. 2004;51(4):937-48.
Burke et al., RNA Aptamers to the Adenosine Moiety of S-adenosyl Methionine: Structural Inferences From Variations on a Theme and the Reproducibility of SELEX. Nucleic Acids Res. May 15, 1997;25(10):2020-4. doi: 10.1093/nar/25.10.2020.
Burstein et al., New CRISPR-Cas systems from uncultivated microbes. Nature Feb. 2017;542(7640):237-240.
Burton et al., Gene delivery using herpes simplex virus vectors. DNA Cell Biol. Dec. 2002;21(12):915-36. doi: 10.1089/104454902762053864.
Buskirk et al., Directed evolution of ligand dependence: small-molecule-activated protein splicing. Proc Natl Acad Sci U S A. Jul. 20, 2004;101(29):10505-10. Epub Jul. 9, 2004.
Buskirk et al., In vivo evolution of an RNA-based transcriptional activator. Chem Biol. Jun. 2003;10(6):533-40. doi: 10.1016/s1074-5521(03)00109-1.
Butt et al., Efficient CRISPR/Cas9-Mediated Genome Editing Using a Chimeric Single-Guide RNA Molecule. Front Plant Sci. Aug. 24, 2017;8:1441(1-8). doi: 10.3389/fpls.2017.01441.
Byrne et al., Multiplex gene regulation: a two-tiered approach to transgene regulation in transgenic mice. Proc Natl Acad Sci U S A. Jul. 1989;86(14):5473-7. doi: 10.1073/pnas.86.14.5473.
Böck et al., Selenocysteine: the 21st amino acid. Mol Microbiol. Mar. 1991;5(3):515-20.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Cadwell et al., Randomization of genes by PCR mutagenesis. PCR Methods Appl. Aug. 1992;2(1):28-33. doi: 10.1101/gr.2.1.28.
Cai et al., Reconstruction of ancestral protein sequences and its applications. BMC Evol Biol. Sep. 17, 2004;4:33. doi: 10.1186/1471-2148-4-33.
Calame et al., Transcriptional controlling elements in the immunoglobulin and T cell receptor loci. Adv Immunol. 1988;43:235-75. doi: 10.1016/s0065-2776(08)60367-3.
Caldecott et al., Single-strand break repair and genetic disease. Nat Rev Genet. Aug. 2008;9(8):619-31. doi: 10.1038/nrg2380.
Camarero et al., Biosynthesis of a Head-to-Tail Cyclized Protein with Improved Biological Activity. J. Am. Chem. Soc. May 29, 1999; 121(23):5597-5598. https://doi.org/10.1021/ja990929n.
Cameron, Recent advances in transgenic technology. Mol Biotechnol. Jun. 1997;7(3):253-65.
Camper et al., Postnatal repression of the alpha-fetoprotein gene is enhancer independent. Genes Dev. Apr. 1989;3(4):537-46. doi: 10.1101/gad.3.4.537.
Camps et al., Targeted gene evolution in *Escherichia coli* using a highly error-prone DNA polymerase I. Proc Natl Acad Sci U S A. Aug. 19, 2003;100(17):9727-32. Epub Aug. 8, 2003.
Canchaya et al., Genome analysis of an inducible prophage and prophage remnants integrated in the *Streptococcus pyogenes* strain SF370. Virology. Oct. 25, 2002;302(2):245-58. doi: 10.1006/viro.2002.1570.
Canny et al., Inhibition of 53BP1 Favors Homology-Dependent DNA Repair and Increases CRISPR-Cas9 Genome-Editing Efficiency. Nat Biotechnol. Jan. 2018;36(1):95-102. doi: 10.1038/nbt.4021. Epub Nov. 27, 2017.
Canver et al., Customizing the genome as therapy for the ?-hemoglobinopathies. Blood. May 26, 2016;127(21):2536-45. doi: 10.1182/blood-2016-01-678128. Epub Apr. 6, 2016.
Cao et al., Rapamycin reverses cellular phenotypes and enhances mutant protein clearance in Hutchinson-Gilford progeria syndrome cells. Sci Transl Med. Jun. 29, 2011;3(89):89ra58. doi: 10.1126/scitranslmed.3002346.
Cargill et al., Characterization of single-nucleotide polymorphisms in coding regions of human genes. Nat Genet. Jul. 1999;22(3):231-8.

(56) References Cited

OTHER PUBLICATIONS

Carlier et al., Burkholderia cenocepacia H111 Rhy-family protein. Apr. 16, 2015. Retrieved from the Internet via https://www.ebi.ac.uk/ena/browser/api/embl/CDN65395.1?lineLimit=1000. Last retrieved Apr. 26, 2021.
Carlson et al., Negative selection and stringency modulation in phage-assisted continuous evolution. Nat Chem Biol. Mar. 2014;10(3):216-22. doi: 10.1038/nchembio.1453. Epub Feb. 2, 2014. With Supplementary Results.
Caron et al., Intracellular delivery of a Tat-eGFP fusion protein into muscle cells. Mol Ther. Mar. 2001;3(3):310-8.
Carr et al., Genome engineering. Nat Biotechnol. Dec. 2009;27(12):1151-62. doi: 10.1038/nbt.1590.
Carroll et al., Gene targeting in *Drosophila* and Caenorhabditis elegans with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Carroll, A CRISPR approach to gene targeting. Mol Ther. Sep. 2012;20(9):1658-60. doi: 10.1038/mt.2012.171.
Carroll, Genome engineering with zinc-finger nucleases. Genetics. Aug. 2011;188(4):773-82. doi: 10.1534/genetics.111.131433. Review.
Carvalho et al., Evolution in health and medicine Sackler colloquium: Genomic disorders: a window into human gene and genome evolution. Proc Natl Acad Sci U S A. Jan. 26, 2010;107 Suppl 1(Suppl 1):1765-71. doi: 10.1073/pnas.0906222107. Epub Jan. 13, 2010.
Caspi et al., Distribution of split DnaE inteins in cyanobacteria. Mol Microbiol. Dec. 2003;50(5):1569-77. doi: 10.1046/j.1365-2958.2003.03825.x.
Cattaneo et al., SEL1L affects human pancreatic cancer cell cycle and invasiveness through modulation of PTEN and genes related to cell-matrix interactions. Neoplasia. 2005;7(11):1030-1038.
Ceccaldi et al., Repair Pathway Choices and Consequences at the Double-Strand Break. Trends Cell Biol. Jan. 2016;26(1):52-64. doi: 10.1016/j.tcb.2015.07.009. Epub Oct. 1, 2015.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Chadalavada et al., Wild-type is the optimal sequence of the HDV ribozyme under cotranscriptional conditions. RNA. Dec. 2007;13(12):2189-201. doi: 10.1261/rna.778107. Epub Oct. 23, 2007.
Chadwick et al., In Vivo Base Editing of PCSK9 (Proprotein Convertase Subtilisin/Kexin Type 9) as a Therapeutic Alternative to Genome Editing. Arterioscler Thromb Vasc Biol. Sep. 2017;37(9):1741-1747. doi: 10.1161/ATVBAHA.117.309881. Epub Jul. 27, 2017.
Chaikind et al., A programmable Cas9-serine recombinase fusion protein that operates on DNA sequences in mammalian cells. Nucleic Acids Res. Nov. 16, 2016;44(20):9758-9770. Epub Aug. 11, 2016.
Chalberg et al., Integration specificity of phage phiC31 integrase in the human genome. J Mol Biol. Mar. 17, 2006;357(1):28-48. doi: 10.1016/j.jmb.2005.11.098. Epub Dec. 22, 2005.
Chalberg et al., phiC31 integrase confers genomic integration and long-term transgene expression in rat retina. Invest Ophthalmol Vis Sci. Jun. 2005;46(6):2140-6. doi: 10.1167/iovs.04-1252.
Chan et al., Molecular recording of mammalian embryogenesis. Nature. Jun. 2019;570(7759):77-82. doi: 10.1038/s41586-019-1184-5. Epub May 13, 2019.
Chan et al., Novel selection methods for DNA-encoded chemical libraries. Curr Opin Chem Biol. 2015;26:55-61. doi:10.1016/j.cbpa.2015.02.010.
Chan et al., The choice of nucleotide inserted opposite abasic sites formed within chromosomal DNA reveals the polymerase activities participating in translesion DNA synthesis. DNA Repair (Amst). Nov. 2013;12(11):878-89. doi: 10.1016/j.dnarep.2013.07.008. Epub Aug. 26, 2013.
Chapman et al., Playing the end game: DNA double-strand break repair pathway choice. Mol Cell. Aug. 24, 2012;47(4):497-510. doi: 10.1016/j.molcel.2012.07.029.
Chari et al., Unraveling CRISPR-Cas9 genome engineering parameters via a library-on-library approach. Nat Methods. Sep. 2015;12(9):823-6. doi: 10.1038/nmeth.3473. Epub Jul. 13, 2015.
Charpentier et al., Biotechnology: Rewriting a genome. Nature. Mar. 7, 2013;495(7439):50-1. doi: 10.1038/495050a.
Chaturvedi et al., Stabilization of triple-stranded oligonucleotide complexes: use of probes containing alternating phosphodiester and stereo-uniform cationic phosphoramidate linkages. Nucleic Acids Res. Jun. 15, 1996;24(12):2318-23.
Chavez et al., Highly efficient Cas9-mediated transcriptional programming. Nat Methods. Apr. 2015;12(4):326-8. doi: 10.1038/nmeth.3312. Epub Mar. 2, 2015.
Chavez et al., Precise Cas9 targeting enables genomic mutation prevention. bioRxiv. Jun. 14, 2016; http://dx/doi.oreg/10.1101/058974. 6 pages. bioRxiv preprint first posted online Jun. 14, 2016.
Chavez et al., Therapeutic applications of the ΦC31 integrase system. Curr Gene Ther. Oct. 2011;11(5):375-81. Review.
Chawla et al., An atlas of RNA base pairs involving modified nucleobases with optimal geometries and accurate energies. Nucleic Acids Res. Aug. 18, 2015;43(14):6714-29. doi: 10.1093/nar/gkv606. Epub Jun. 27, 2015.
Chelico et al., Biochemical basis of immunological and retroviral responses to DNA-targeted cytosine deamination by activation-induced cytidine deaminase and APOBEC3G. J Biol Chem. Oct. 9, 2009;284(41):27761-5. doi: 10.1074/jbc.R109.052449. Epub Aug. 13, 2009.
Chelico et al., Stochastic properties of processive cytidine DNA deaminases AID and APOBEC3G. Philos Trans R Soc Lond B Biol Sci. Mar. 12, 2009;364(1517):583-93. doi: 10.1098/rstb.2008.0195.
Chen et al., Enhanced proofreading governs CRISPR-Cas9 targeting accuracy. Nature. Oct. 19, 2017;550(7676):407-410. doi: 10.1038/nature24268. Epub Sep. 20, 2017.
Chen et al., A general strategy for the evolution of bond-forming enzymes using yeast display. Proc Natl Acad Sci U S A. Jul. 12, 2011;108(28):11399-404. doi: 10.1073/pnas.1101046108. Epub Jun. 22, 2011.
Chen et al., Alterations in PMS2, MSH2 and MLH1 expression in human prostate cancer. Int J Oncol. May 2003;22(5):1033-43.
Chen et al., Enhanced prime editing systems by manipulating cellular determinants of editing outcomes. Cell. Oct. 28, 2021;184(22):5635-5652.e29. doi: 10.1016/j.cell.2021.09.018. Epub Oct. 14, 2021.
Chen et al., Fusion protein linkers: property, design and functionality. Adv Drug Deliv Rev. Oct. 2013;65(10):1357-69. doi: 10.1016/j.addr.2012.09.039. Epub Sep. 29, 2012.
Chen et al., Genome-wide CRISPR screen in a mouse model of tumor growth and metastasis. Cell. Mar. 12, 2015;160(6):1246-60. doi: 10.1016/j.cell.2015.02.038. Epub Mar. 5, 2015.
Chen et al., Highly Efficient Mouse Genome Editing by CRISPR Ribonucleoprotein Electroporation of Zygotes. J Biol Chem. Jul. 8, 2016;291(28):14457-67. doi: 10.1074/jbc.M116.733154. Epub May 5, 2016.
Chen et al., m(6)A RNA methylation is regulated by microRNAs and promotes reprogramming to pluripotency. Cell Stem Cell. Mar. 5, 2015;16(3):289-301. doi: 10.1016/j.stem.2015.01.016. Epub Feb. 12, 2015.
Chen et al., Structure of the DNA deaminase domain of the HIV-1 restriction factor APOBEC3G. Nature. Mar. 6, 2008;452(7183):116-9. doi: 10.1038/nature06638. Epub Feb. 20, 2008.
Chen et al., Targeting genomic rearrangements in tumor cells through Cas9-mediated insertion of a suicide gene. Nat Biotechnol. Jun. 2017;35(6):543-550. doi: 10.1038/nbt.3843. Epub May 1, 2017.
Cheng et al., Multiplexed activation of endogenous genes by CRISPR-on, an RNA-guided transcriptional activator system. Cell Res. Oct. 2013;23(10):1163-71. doi: 10.1038/cr.2013.122. Epub Aug. 27, 20137.
Chesnoy et al., Structure and function of lipid-DNA complexes for gene delivery. Annu Rev Biophys Biomol Struct. 2000;29:27-47.

(56) References Cited

OTHER PUBLICATIONS

Chester et al., The apolipoprotein B mRNA editing complex performs a multifunctional cycle and suppresses nonsense-mediated decay. EMBO J. Aug. 1, 2003;22(15):3971-82. doi: 10.1093/emboj/cdg369.
Chew et al., A multifunctional AAV-CRISPR-Cas9 and its host response. Nat Methods. Oct. 2016;13(10):868-74. doi: 10.1038/nmeth.3993. Epub Sep. 5, 2016.
Chew et al., A multifunctional AAV-CRISPR-Cas9 and its host response. Nat Methods. Oct. 2016;13(10):868-74. doi: 10.1038/nmeth.3993. Epub Sep. 5, 2016. Supplementary Information.
Chichili et al., Linkers in the structural biology of protein-protein interactions. Protein Science. 2013;22:153-67.
Chin, Expanding and reprogramming the genetic code of cells and animals. Annu Rev Biochem. 2014;83:379-408. doi: 10.1146/annurev-biochem-060713-035737. Epub Feb. 10, 2014.
Chipev et al., A leucine—proline mutation in the H1 subdomain of keratin 1 causes epidermolytic hyperkeratosis. Cell. Sep. 4, 1992;70(5):821-8.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Cho et al., Site-specific recombination of bacteriophage P22 does not require integration host factor. J Bacteriol. Jul. 1999; 181(14):4245-9. doi: 10.1128/JB.181.14.4245-4249.1999.
Cho et al., Targeted genome engineering in human cells with the Cas9 RNA-guided endonuclease. Nat Biotechnol. Mar. 2013;31(3):230-2. doi: 10.1038/nbt.2507. Epub Jan. 29, 2013.
Cho et al., The calcium-activated chloride channel anoctamin 1 acts as a heat sensor in nociceptive neurons. Nat Neurosci. May 27, 2012;15(7):1015-21. doi: 10.1038/nn.3111.
Choe et al., Forging Ahead through Darkness: PCNA, Still the Principal Conductor at the Replication Fork. Mol Cell. Feb. 2, 2017;65(3):380-392. doi: 10.1016/j.molcel.2016.12.020.
Choi et al., (6)-methyladenosine in mRNA disrupts tRNA selection and translation-elongation dynamics. Nat Struct Mol Biol. Feb. 2016;23(2):110-5. doi: 10.1038/nsmb.3148. Epub Jan. 11, 2016.
Choi et al., Protein trans-splicing and characterization of a split family B-type DNA polymerase from the hyperthermophilic archaeal parasite Nanoarchaeum equitans. J Mol Biol. Mar. 10, 2006;356(5):1093-106. doi: 10.1016/j.jmb.2005.12.036. Epub Dec. 27, 2005.
Choi et at al., Translesion synthesis across abasic lesions by human B-family and Y-family DNA polymerases ?, ?, ?, ?, ?, and REV1. J Mol Biol. Nov. 19, 2010;404(1):34-44. doi: 10.1016/j.jmb.2010.09.015. Epub Oct. 1, 2010.
Chong et al., Modulation of protein splicing of the *Saccharomyces cerevisiae* vacuolar membrane ATPase intein. J Biol Chem. Apr. 24, 1998;273(17):10567-77. doi: 10.1074/jbc.273.17.10567.
Chong et al., Utilizing the C-terminal cleavage activity of a protein splicing element to purify recombinant proteins in a single chromatographic step. Nucleic Acids Res. Nov. 15, 1998;26(22):5109-15. doi: 10.1093/nar/26.22.5109.
Chong et al., Protein splicing involving the *Saccharomyces cerevisiae* VMA intein. The steps in the splicing pathway, side reactions leading to protein cleavage, and establishment of an in vitro splicing system. J Biol Chem. Sep. 6, 1996;271(36):22159-68. doi: 10.1074/jbc.271.36.22159.
Chong et al., Protein splicing of the *Saccharomyces cerevisiae* VMA intein without the endonuclease motifs. J Biol Chem. Jun. 20, 1997;272(25):15587-90. doi: 10.1074/jbc.272.25.15587.
Chong et al., Single-column purification of free recombinant proteins using a self-cleavable affinity tag derived from a protein splicing element. Gene. Jun. 19, 1997;192(2):271-81. doi: 10.1016/s0378-1119(97)00105-4.
Choudhury et al., CRISPR-dCas9 mediated TET1 targeting for selective DNA demethylation at BRCA1 promoter. Oncotarget. Jul. 19, 2016;7(29):46545-46556. doi: 10.18632/oncotarget.10234.
Choudhury et al., CRISPR/Cas9 recombineering-mediated deep mutational scanning of essential genes in *Escherichia coli*. Mol Syst Biol. Mar. 2020;16(3):e9265. doi: 10.15252/msb.20199265.
Choudhury et al., Engineering RNA endonucleases with customized sequence specificities. Nat Commun. 2012;3:1147. doi: 10.1038/ncomms2154.
Choulika et al., Induction of homologous recombination in mammalian chromosomes by using the I-Scel system of *Saccharomyces cerevisiae*. Mol Cell Biol. Apr. 1995;15(4):1968-73. doi: 10.1128/MCB.15.4.1968.
Christian et al., Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2010;186(2):757-61. Doi: 10.1534/genetics.110.120717. Epub Jul. 26, 2010.
Christiansen et al., Characterization of the lactococcal temperate phage TP901-1 and its site-specific integration. J Bacteriol. Feb. 1994;176(4):1069-76. doi: 10.1128/jb.176.4.1069-1076.1994.
Chu et al., Increasing the efficiency of homology-directed repair for CRISPR-Cas9-induced precise gene editing in mammalian cells. Nat Biotech. Feb. 13, 2015;33:543-8. doi: 10.1038/nbt.3198. Epub Mar. 24, 2015.
Chuai et al., DeepCRISPR: optimized CRISPR guide RNA design by deep learning. Genome Biol. Jun. 26, 2018;19(1):80. doi: 10.1186/s13059-018-1459-4.
Chuai et al., In Silico Meets In Vivo: Towards Computational CRISPR-Based sgRNA Design. Trends Biotechnol. Jan. 2017;35(1):12-21. doi: 10.1016/j.tibtech.2016.06.008. Epub Jul. 11, 2016.
Chuang et al., Novel Heterotypic Rox Sites for Combinatorial Dre Recombination Strategies. G3 (Bethesda). Dec. 29, 2015;6(3):559-71. doi: 10.1534/g3.115.025841.
Chujo et al., Trmt61B is a methyltransferase responsible for 1-methyladenosine at position 58 of human mitochondrial tRNAs. RNA. Dec. 2012;18(12):2269-76. doi: 10.1261/rna.035600.112. Epub Oct. 24, 2012.
Chung-Il et al., Artificial control of gene expression in mammalian cells by modulating RNA interference through aptamer-small molecule interaction. RNA. May 2006;12(5):710-6. Epub Apr. 10, 2006.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Clackson et al., Redesigning an FKBP-ligand interface to generate chemical dimerizers with novel specificity. Proc Natl Acad Sci U S A. Sep. 1, 1998;95(18):10437-42. doi: 10.1073/pnas.95.18.10437.
Clement et al., CRISPResso2 provides accurate and rapid genome editing sequence analysis. Nat Biotechnol. Mar. 2019;37(3):224-226. doi: 10.1038/s41587-019-0032-3.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Coffey et al., The Economic Impact of BSE on the U.S. Beef Industry: Product Value Losses, Regulatory Costs, and Consumer Reactions. Kansas State University Agricultural Experiment Station and Cooperative Extension Service. MF-2678. May 2005. 68 pages. Accessed via https://bookstore.ksre.ksu.edu/pubs/MF2678.pdf.
Cokol et al., Finding nuclear localization signals. EMBO Rep. Nov. 2000;1(5):411-5. doi: 10.1093/embo-reports/kvd092.
Cole et al., Reconstructing evolutionary adaptive paths for protein engineering. Methods Mol Biol. 2013;978:115-25. doi: 10.1007/978-1-62703-293-3_8.
Cole-Strauss et al., Correction of the mutation responsible for sickle cell anemia by an RNA-DNA oligonucleotide. Science. Sep. 6, 1996;273(5280):1386-9.
Collinge, Prion diseases of humans and animals: their causes and molecular basis. Annu Rev Neurosci. 2001;24:519-50. doi: 10.1146/annurev.neuro.24.1.519.
Cong et al., Multiplex genome engineering using CRISPR/Cas systems. Science. Feb. 15, 2013;339(6121):819-23. doi: 10.1126/science.1231143. Epub Jan. 3, 2013.

(56) References Cited

OTHER PUBLICATIONS

Conrad et al., A Kaposi's sarcoma virus RNA element that increases the nuclear abundance of intronless transcripts. EMBO J. May 18, 2005;24(10):1831-41. doi: 10.1038/sj.emboj.7600662. Epub Apr. 28, 2005.
Conticello, The AID/APOBEC family of nucleic acid mutators. Genome Biol. 2008;9(6):229. doi: 10.1186/GB-2008-9-6-229. Epub Jun. 17, 2008.
Cornu et al., Refining strategies to translate genome editing to the clinic. Nat Med. Apr. 3, 2017;23(4):415-423. doi: 10.1038/nm.4313.
Costa et al., Frequent use of the same tertiary motif by self-folding RNAs. EMBO J. Mar. 15, 1995;14(6):1276-85.
Cotton et al., Insertion of a Synthetic Peptide into a Recombinant Protein Framework: A Protein Biosensor. J. Am. Chem. Soc. Jan. 22, 1999; 121(5):1100-1. https://doi.org/10.1021/ja983804b.
Covino et al., The CCL2/CCR2 Axis in the Pathogenesis of HIV-1 Infection: A New Cellular Target for Therapy? Current Drug Targets Dec. 2016;17(1):76-110. DOI : 10.2174/138945011701151217110917.
Cox et al., An SCN9A channelopathy causes congenital inability to experience pain. Nature. Dec. 14, 2006;444(7121):894-8. doi: 10.1038/nature05413.
Cox et al., Conditional gene expression in the mouse inner ear using Cre-loxP. J Assoc Res Otolaryngol. Jun. 2012;13(3):295-322. doi: 10.1007/s10162-012-0324-5. Epub Apr. 24, 2012.
Cox et al., Congenital insensitivity to pain: novel SCN9A missense and in-frame deletion mutations. Hum Mutat. Sep. 2010;31(9):E1670-86. doi: 10.1002/humu.21325.
Cox et al., RNA editing with CRISPR-Cas13. Science. Nov. 24, 2017;358(6366):1019-1027. doi: 10.1126/science.aaq0180. Epub Oct. 25, 2017.
Cox et al., Therapeutic genome editing: prospects and challenges. Nat Med. Feb. 2015;21(2):121-31. doi: 10.1038/nm.3793.
Cox, Proteins pinpoint double strand breaks. Elife. Oct. 29, 2013;2:e01561. doi: 10.7554/eLife.01561.
Crabtree et al., Three-part inventions: intracellular signaling and induced proximity. Trends Biochem Sci. Nov. 1996;21(11):418-22. doi: 10.1016/s0968-0004(96)20027-1.
Cradick et al., CRISPR/Cas9 systems targeting ß-globin and CCR5 genes have substantial off-target activity. Nucleic Acids Res. Nov. 1, 2013;41(20):9584-92. doi: 10.1093/nar/gkt714. Epub Aug. 11, 2013.
Cradick et al., ZFN-site searches genomes for zinc finger nuclease target sites and off-target sites. BMC Bioinformatics. May 13, 2011;12:152. doi: 10.1186/1471-2105-12-152.
Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.
Crick, On protein synthesis. Symp Soc Exp Biol. 1958;12:138-63.
Cronican et al., A class of human proteins that deliver functional proteins into mammalian cells in vitro and in vivo. Chem Biol. Jul. 29, 2011;18(7):833-8. doi: 10.1016/j.chembiol.2011.07.003.
Cronican et al., Potent delivery of functional proteins into Mammalian cells in vitro and in vivo using a supercharged protein. ACS Chem Biol. Aug. 20, 2010;5(8):747-52. doi:10.1021/cb1001153.
Crystal, Transfer of genes to humans: early lessons and obstacles to success. Science. Oct. 20, 1995;270(5235):404-10. doi: 10.1126/science.270.5235.404.
Cui et al., Consequences of Cas9 cleavage in the chromosome of *Escherichia coli*. Nucleic Acids Res. May 19, 2016;44(9):4243-51. doi: 10.1093/nar/gkw223. Epub Apr. 8, 2016.
Cui et al., m6A RNA Methylation Regulates the Self-Renewal and Tumorigenesis of Glioblastoma Stem Cells. Cell Rep. Mar. 14, 2017;18(11):2622-2634. doi: 10.1016/j.celrep.2017.02.059.
Cui et al., Review of CRISPR/Cas9 sgRNA Design Tools. Interdiscip Sci. Jun. 2018;10(2):455-465. doi: 10.1007/s12539-018-0298-z. Epub Apr. 11, 2018.
Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.
Cunningham et al., Ensembl 2015. Nucleic Acids Res. Jan. 2015;43(Database issue):D662-9. doi: 10.1093/nar/gku1010. Epub Oct. 28, 2014.
Cupples et al., A set of lacZ mutations in *Escherichia coli* that allow rapid detection of each of the six base substitutions. Proc Natl Acad Sci U S A. Jul. 1989;86(14):5345-9.
D'Adda di Fagagna et al., The Gam protein of bacteriophage Mu is an orthologue of eukaryotic Ku. EMBO Rep. Jan. 2003;4(1):47-52.
Dahlem et al., Simple methods for generating and detecting locus-specific mutations induced with TALENs in the zebrafish genome. PLoS Genet. 2012;8(8):e1002861. doi: 10.1371/journal.pgen.1002861. Epub Aug. 16, 2012.
Dahlgren et al., A novel mutation in ribosomal protein S4 that affects the function of a mutated RF1. Biochimie. Aug. 2000;82(8):683-91.
Dahlman et al., Orthogonal gene knockout and activation with a catalytically active Cas9 nuclease. Nat Biotechnol. Nov. 2015;33(11):1159-61. doi: 10.1038/nbt.3390.
Dandage et al., beditor: A Computational Workflow for Designing Libraries of Guide RNAs for CRISPR-Mediated Base Editing. Genetics. Jun. 2019;212(2):377-385. doi: 10.1534/genetics.119.302089. Epub Apr. 1, 2019.
Dang et al., Optimizing sgRNA structure to improve CRISPR-Cas9 knockout efficiency. Genome Biol. Dec. 15, 2015;16:280. doi: 10.1186/s13059-015-0846-3.
Das et al., The crystal structure of the monomeric reverse transcriptase from Moloney murine leukemia virus. Structure. May 2004;12(5):819-29. doi: 10.1016/j.str.2004.02.032.
Dassa et al., Fractured genes: a novel genomic arrangement involving new split inteins and a new homing endonuclease family. Nucleic Acids Res. May 2009;37(8):2560-73. doi: 10.1093/nar/gkp095. Epub Mar. 5, 2009.
Dassa et al., Trans protein splicing of cyanobacterial split inteins in endogenous and exogenous combinations. Biochemistry. Jan. 9, 2007;46(1):322-30. doi: 10.1021/bi0611762.
DataBase EBI Accession No. ADE34233 Jan. 29, 2004.
DataBase EBI Accession No. BFF09785. May 31, 2018. 2 pages.
DataBase EBI Accession No. BGE38086. Jul. 25, 2019. 2 pages.
DataBase UniProt Accession No. G813E0. Jan. 14, 2012.
Datsenko et al., One-step inactivation of chromosomal genes in *Escherichia coli* K-12 using PCR products. Proc Natl Acad Sci U S A. Jun. 6, 2000;97(12):6640-5.
Davidson et al., Viral vectors for gene delivery to the nervous system. Nat Rev Neurosci. May 2003;4(5):353-64. doi: 10.1038/nrn1104.
Davis et al., Assaying Repair at DNA Nicks. Methods Enzymol. 2018;601:71-89. doi: 10.1016/bs.mie.2017.12.001. Epub Feb. 1, 2018.
Davis et al., DNA double strand break repair via non-homologous end-joining. Transl Cancer Res. Jun. 2013;2(3):130-143.
Davis et al., Homology-directed repair of DNA nicks via pathways distinct from canonical double-strand break repair. Proc Natl Acad Sci U S A. Mar. 11, 2014;111(10):E924-32. doi: 10.1073/pnas.1400236111. Epub Feb. 20, 2014.
Davis et al., Small molecule-triggered Cas9 protein with improved genome-editing specificity. Nat Chem Biol. May 2015;11(5):316-8. doi: 10.1038/nchembio.1793. Epub Apr. 6, 2015.
Davis et al., Two Distinct Pathways Support Gene Correction by Single-Stranded Donors at DNA Nicks. Cell Rep. Nov. 8, 2016;17(7):1872-1881. doi: 10.1016/j.celrep.2016.10.049.
De Felipe et al., Co-translational, intraribosomal cleavage of polypeptides by the foot-and-mouth disease virus 2A peptide. J Biol Chem. Mar. 28, 2003;278(13):11441-8. doi: 10.1074/jbc.M211644200. Epub Jan. 8, 2003.
De La Peña et al., The Hammerhead Ribozyme: A Long History for a Short RNA. Molecules. Jan. 4, 2017;22(1):78. doi: 10.3390/molecules22010078.
De Sandre-Giovannoli et al., Lamin a truncation in Hutchinson-Gilford progeria. Science. Jun. 27, 2003;300(5628):2055. doi: 10.1126/science.1084125. Epub Apr. 17, 2003.
De Souza, Primer: genome editing with engineered nucleases. Nat Methods. Jan. 2012;9(1):27.

(56) References Cited

OTHER PUBLICATIONS

De Wit et al., The Human CD4+ T Cell Response against Mumps Virus Targets a Broadly Recognized Nucleoprotein Epitope. J Virol. Mar. 5, 2019;93(6):e01883-18. doi: 10.1128/JVI.01883-18.
Dean et al., Genetic restriction of HIV-1 infection and progression to AIDS by a deletion allele of the CKR5 structural gene. Hemophilia Growth and Development Study, Multicenter AIDS Cohort Study, Multicenter Hemophilia Cohort Study, San Francisco City Cohort, ALIVE Study. Science. Sep. 27, 1996;273(5283):1856-62. doi: 10.1126/science.273.5283.1856.
DeKosky et al., Large-scale sequence and structural comparisons of human naive and antigen-experienced antibody repertoires. Proc Natl Acad Sci U S A. May 10, 2016;113(19):E2636-45. doi: 10.1073/pnas.1525510113. Epub Apr. 25, 2016.
Delebecque et al., Organization of intracellular reactions with rationally designed RNA assemblies. Science. Jul. 22, 2011;333(6041):470-4. doi: 10.1126/science.1206938. Epub Jun. 23, 2011.
Deltcheva et al., CRISPR RNA maturation by trans-encoded small RNA and host factor RNase III. Nature. Mar. 31, 2011;471(7340):602-7. doi: 10.1038/nature09886.
Deng et al., Widespread occurrence of N6-methyladenosine in bacterial mRNA. Nucleic Acids Res. Jul. 27, 2015;43(13):6557-67. doi: 10.1093/nar/gkv596. Epub Jun. 11, 2015.
Denizio et al., Harnessing natural DNA modifying activities for editing of the genome and epigenome. Curr Opin Chem Biol. Aug. 2018;45:10-17. doi: 10.1016/j.cbpa.2018.01.016. Epub Feb. 13, 2018.
Deriano et al., Modernizing the nonhomologous end-joining repertoire: alternative and classical NHEJ share the stage. Annu Rev Genet. 2013;47:433-55. doi: 10.1146/annurev-genet-110711-155540. Epub Sep. 11, 2013.
Deussing, Targeted mutagenesis tools for modelling psychiatric disorders. Cell Tissue Res. Oct. 2013;354(1):9-25. doi: 10.1007/s00441-013-1708-5. Epub Sep. 10, 2013.
Dever et al., CRISPR/Cas9 ?-globin gene targeting in human haematopoietic stem cells. Nature. Nov. 17, 2016;539(7629):384-389. doi: 10.1038/nature20134. Epub Nov. 7, 2016.
Deverman et al., Cre-dependent selection yields AAV variants for widespread gene transfer to the adult brain. Nat Biotechnol. Feb. 2016;34(2):204-9. doi: 10.1038/nbt.3440. Epub Feb. 1, 2016.
Devigili et al., Paroxysmal itch caused by gain-of-function Nav1.7 mutation. Pain. Sep. 2014;155(9):1702-1707. doi: 10.1016/j.pain.2014.05.006. Epub May 10, 2014.
Dianov et al., Mammalian base excision repair: the forgotten archangel. Nucleic Acids Res. Apr. 1, 2013;41(6):3483-90. doi: 10.1093/nar/gkt076. Epub Feb. 13, 2013.
Dicarlo et al., Genome engineering in *Saccharomyces cerevisiae* using CRISPR-Cas systems. Nucleic Acids Research Apr. 2013;41(7):4336-43.
Dicarlo et al., Genome engineering in *Saccharomyces cerevisiae* using CRISPR-Cas systems. Nucleic Acids Res. Apr. 2013;41(7):4336-43. doi: 10.1093/nar/gkt135. Epub Mar. 4, 2013.
Dicarlo et al., Safeguarding CRISPR-Cas9 gene drives in yeast. Nat Biotechnol. Dec. 2015;33(12):1250-1255. doi: 10.1038/nbt.3412. Epub Nov. 16, 2015.
Dickey et al., Single-stranded DNA-binding proteins: multiple domains for multiple functions. Structure. Jul. 2, 2013;21(7):1074-84. doi: 10.1016/j.str.2013.05.013.
Dickinson et al., Experimental interrogation of the path dependence and stochasticity of protein evolution using phage-assisted continuous evolution. Proc Natl Acad Sci USA. May 2013;110(22):9007-12.
Dillon, Regulating gene expression in gene therapy. Trends Biotechnol. May 1993;11(5):167-73. doi: 10.1016/0167-7799(93)90109-M.
Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.
Ding et al., Permanent alteration of PCSK9 with in vivo CRISPR-Cas9 genome editing. Circ Res. Aug. 15, 2014;115(5):488-92. doi: 10.1161/CIRCRESAHA.115.304351. Epub Jun. 10, 2014.
Dingwall et al., Nuclear targeting sequences—a consensus? Trends Biochem Sci. Dec. 1991;16(12):478-81. doi: 10.1016/0968-0004(91)90184-w.
Diver et al., Single-Step Synthesis of Cell-Permeable Protein Dimerizers That Activate Signal Transduction and Gene Expression. J. Am. Chem. Soc. Jun. 4, 1997;119(22):5106-5109. https://doi.org/10.1021/ja963891c.
Dixon et al., Reengineering orthogonally selective riboswitches. Proc Natl Acad Sci U S A. Feb. 16, 2010;107(7):2830-5. doi: 10.1073/pnas.0911209107. Epub Jan. 26, 2010.
Doench et al., Optimized sgRNA design to maximize activity and minimize off-target effects of CRISPR-Cas9. Nat Biotechnol. Feb. 2016;34(2):184-191. doi: 10.1038/nbt.3437.
Doench et al., Rational design of highly active sgRNAs for CRISPR-Cas9-mediated gene inactivation. Nat Biotechnol. Dec. 2014;32(12):1262-7. doi: 10.1038/nbt.3026. Epub Sep. 3, 2014.
Dolan et al., Trans-splicing with the group I intron ribozyme from Azoarcus. RNA. Feb. 2014;20(2):202-13. doi: 10.1261/rna.041012.113. Epub Dec. 16, 2013.
Doman et al., Evaluation and minimization of Cas9-independent off-target DNA editing by cytosine base editors. Nat Biotechnol. May 2020;38(5):620-628. doi: 10.1038/s41587-020-0414-6. Epub Feb. 10, 2020.
Dominissini et al., Topology of the human and mouse m6A RNA methylomes revealed by m6A-seq. Nature. Apr. 29, 2012;485(7397):201-6. doi: 10.1038/nature11112.
Dorgan et al., An enzyme-coupled continuous spectrophotometric assay for S-adenosylmethionine-dependent methyltransferases. Anal Biochem. Mar. 15, 2006;350(2):249-55. doi: 10.1016/j.ab.2006.01.004. Epub Feb. 7, 2006.
Dormiani et al., Long-term and efficient expression of human ß-globin gene in a hematopoietic cell line using a new site-specific integrating non-viral system. Gene Ther. Aug. 2015;22(8):663-74. doi: 10.1038/gt.2015.30. Epub Apr. 1, 2015.
Dorr et al., Reprogramming the specificity of sortase enzymes. Proc Natl Acad Sci U S A. Sep. 16, 2014;111(37):13343-8. doi: 10.1073/pnas.1411179111. Epub Sep. 3, 2014.
Doudna et al., Genome editing. The new frontier of genome engineering with CRISPR-Cas9. Science. Nov. 28, 2014;346(6213):1258096. doi: 10.1126/science.1258096.
Doudna, The promise and challenge of therapeutic genome editing. Nature. Feb. 2020;578(7794):229-236. doi: 10.1038/s41586-020-1978-5. Epub Feb. 12, 2020.
Dove et al., Conversion of the omega subunit of *Escherichia coli* RNA polymerase into a transcriptional activator or an activation target. Genes Dev. Mar. 1, 1998;12(5):745-54.
Doyon et al., Directed evolution and substrate specificity profile of homing endonuclease I-SceI. J Am Chem Soc. Feb. 22, 2006;128(7):2477-84.
Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.
Drake, A constant rate of spontaneous mutation in DNA-based microbes. Proc Natl Acad Sci U S A. Aug. 15, 1991;88(16):7160-4.
Drost et al., Inactivation of DNA mismatch repair by variants of uncertain significance in the PMS2 gene. Hum Mutat. Nov. 2013;34(11):1477-80. doi: 10.1002/humu.22426. Epub Sep. 11, 2013.
Duan et al., Enhancement of muscle gene delivery with pseudotyped adeno-associated virus type 5 correlates with myoblast differentiation. J Virol. Aug. 2001;75(16):7662-71. doi: 10.1128/JVI.75.16.7662-7671.2001.
Dubois et al., Retroviral RNA Dimerization: From Structure to Functions. Front Microbiol. Mar. 22, 2018;9:527. doi: 10.3389/fmicb.2018.00527.
Dumas et al., Designing logical codon reassignment—Expanding the chemistry in biology. Chem Sci. Jan. 1, 2015;6(1):50-69. doi: 10.1039/c4sc01534g. Epub Jul. 14, 2014. Review.
Dunaime, Breakthrough method means CRISPR just got a lot more relevant to human health. The Verge. Apr. 20, 2016. http://www.

(56) References Cited

OTHER PUBLICATIONS theverge.com/2016/4/20/11450262/crispr-base-editing-single-nucleotides-dna-gene-liu-harvard.
Dunbar et al., Gene therapy comes of age. Science. Jan. 12, 2018;359(6372):eaan4672. doi: 10.1126/science.aan4672.
Dupuy et al., Le syndrome de De La Chapelle [De La Chapelle syndrome]. Presse Med. Mar. 3, 2001;30(8):369-72. French.
Durai et al., A bacterial one-hybrid selection system for interrogating zinc finger-DNA interactions. Comb Chem High Throughput Screen. May 2006;9(4):301-11.
Durai et al., Zinc finger nucleases: custom-designed molecular scissors for genome engineering of plant and mammalian cells. Nucleic Acids Res. Oct. 26, 2005;33(18):5978-90. doi: 10.1093/nar/gki912.
During et al., Controlled release of dopamine from a polymeric brain implant: in vivo characterization. Ann Neurol. Apr. 1989;25(4):351-6.
East-Seletsky et al., Two distinct RNase activities of CRISPR-C2c2 enable guide-RNA processing and RNA detection. Nature Oct. 2016;538(7624):270-3.
Edlund et al., Cell-specific expression of the rat insulin gene: evidence for role of two distinct 5' flanking elements. Science. Nov. 22, 1985;230(4728):912-6. doi: 10.1126/science.3904002.
Edwards et al., An *Escherichia coli* tyrosine transfer RNA is a leucine-specific transfer RNA in the yeast *Saccharomyces cerevisiae*. Proc Natl Acad Sci U S A. Feb. 15, 1991;88(4):1153-6.
Edwards et al., Crystal structures of the thi-box riboswitch bound to thiamine pyrophosphate analogs reveal adaptive RNA-small molecule recognition. Structure. Sep. 2006;14(9):1459-68.
Eick et al., Robustness of Reconstructed Ancestral Protein Functions to Statistical Uncertainty. Mol Biol Evol. Feb. 1, 2017;34(2):247-261. doi: 10.1093/molbev/msw223.
Eiler et al., Structural Basis for the Fast Self-Cleavage Reaction Catalyzed by the Twister Ribozyme. Proc Natl Acad Sci U S A. Sep. 9, 2014;111(36):13028-33. doi: 10.1073/pnas.1414571111. Epub Aug. 25, 2014.
Eisenberg et al., A-to-I RNA editing—immune protector and transcriptome diversifier. Nat Rev Genet. Aug. 2018; 19(8):473-490. doi: 10.1038/s41576-018-0006-1.
Eltoukhy et al., Nucleic acid-mediated intracellular protein delivery by lipid-like nanoparticles. Biomaterials. Aug. 2014;35(24):6454-61. doi: 10.1016/j.biomaterials.2014.04.014. Epub May 13, 2014.
Emery et al., HCN2 ion channels play a central role in inflammatory and neuropathic pain. Science. Sep. 9, 2011;333(6048):1462-6. doi: 10.1126/science.1206243.
Endo et al., Toward establishing an efficient and versatile gene targeting system in higher plants. Biocatalysis and Agricultural Biotechnology 2014;3,(1):2-6.
Engel et al., The emerging role of mRNA methylation in normal and pathological behavior. Genes Brain Behav. Mar. 2018;17(3):e12428. doi: 10.1111/gbb.12428. Epub Nov. 17, 2017.
Engelward et al., Base excision repair deficient mice lacking the Aag alkyladenine DNA glycosylase. Proc Natl Acad Sci U S A. Nov. 25, 1997;94(24):13087-92.
England, Unnatural amino acid mutagenesis: a precise tool for probing protein structure and function. Biochemistry. Sep. 21, 2004;43(37):11623-9.
Enyeart et al., Biotechnological applications of mobile group II introns and their reverse transcriptases: gene targeting, RNA-seq, and non-coding RNA analysis. Mobile DNA 5, 2 (2014). https://doi.org/10.1186/1759-8753-5-2. https://doi.org/10.1186/1759-8753-5-2.
Epstein, HSV-1-based amplicon vectors: design and applications. Gene Ther. Oct. 2005;12 Suppl 1:S154-8. doi: 10.1038/sj.gt.3302617.
Eriksson et al., Recurrent de novo point mutations in lamin A cause Hutchinson-Gilford progeria syndrome. Nature. May 15, 2003;423(6937):293-8. doi: 10.1038/nature01629. Epub Apr. 25, 2003. PMID: 12714972.
Estacion et al., A sodium channel gene SCN9A polymorphism that increases nociceptor excitability. Ann Neurol. Dec. 2009;66(6):862-6. doi: 10.1002/ana.21895.
Esvelt et al., A system for the continuous directed evolution of biomolecules. Nature. Apr. 28, 2011;472(7344):499-503. doi: 10.1038/nature09929. Epub Apr. 10, 2011.
Esvelt et al., Genome-scale engineering for systems and synthetic biology. Mol Syst Biol. 2013;9:641. doi: 10.1038/msb.2012.66.
Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.
Evans et al., Protein trans-splicing and cyclization by a naturally split intein from the dnaE gene of *Synechocystis* species PCC6803. J Biol Chem. Mar. 31, 2000;275(13):9091-4. doi: 10.1074/jbc.275.13.9091.
Evans et al., Semisynthesis of cytotoxic proteins using a modified protein splicing element. Protein Sci. Nov. 1998;7(11):2256-64. doi: 10.1002/pro.5560071103.
Evans et al., The cyclization and polymerization of bacterially expressed proteins using modified self-splicing inteins. J Biol Chem. Jun. 25, 1999;274(26):18359-63. doi: 10.1074/jbc.274.26.18359.
Evans et al., The in vitro ligation of bacterially expressed proteins using an intein from Methanobacterium thermoautotrophicum. J Biol Chem. Feb. 12, 1999;274(7):3923-6. doi: 10.1074/jbc.274.7.3923.
Evers et al., CRISPR knockout screening outperforms shRNA and CRISPRi in identifying essential genes. Nat Biotechnol. Jun. 2016;34(6):631-3. doi: 10.1038/nbt.3536. Epub Apr. 25, 2016.
Fagerlund et al., The Cpf1 CRISPR-Cas protein expands genome-editing tools. Genome Biology Nov. 17, 2015;16:251. https://doi.org/10.1186/s13059-015-0824-9.
Falnes et al., DNA repair by bacterial AlkB proteins. Res Microbiol. Oct. 2003;154(8):531-8. doi: 10.1016/S0923-2508(03)00150-5.
Falnes et al., Repair of methyl lesions in DNA and RNA by oxidative demethylation. Neuroscience. Apr. 14, 2007;145(4):1222-32. doi: 10.1016/j.neuroscience.2006.11.018. Epub Dec. 18, 2006.
Fang et al., Synthetic Studies Towards Halichondrins: Synthesis of the Left Halves of Norhalichondrins and Homohalichondrins. Tetrahedron Letters 1992;33(12):1557-1560.
Farboud et al., Dramatic enhancement of genome editing by CRISPR/Cas9 through improved guide RNA design. Genetics. Apr. 2015;199(4):959-71. doi: 10.1534/genetics.115.175166. Epub Feb. 18, 2015.
Farhood et al., Codelivery to mammalian cells of a transcriptional factor with cis-acting element using cationic liposomes. Anal Biochem. Feb. 10, 1995;225(1):89-93.
Fawcett et al., Transposable elements controlling I-R hybrid dysgenesis in *D. melanogaster* are similar to mammalian LINEs. Cell. Dec. 26, 1986;47(6):1007-15. doi: 10.1016/0092-8674(86)90815-9.
Feldstein et al., Two sequences participating in the autolytic processing of satellite tobacco ringspot virus complementary RNA. Gene. Oct. 15, 1989;82(1):53-61. doi: 10.1016/0378-1119(89)90029-2.
Felletti et al., Twister Ribozymes as Highly Versatile Expression Platforms for Artificial Riboswitches. Nat Commun. Sep. 27, 2016;7:12834. doi: 10.1038/ncomms12834.
Feng et al., Crystal structures of the human RNA demethylase Alkbh5 reveal basis for substrate recognition. J Biol Chem. Apr. 25, 2014;289(17):11571-11583. doi: 10.1074/jbc.M113.546168. Epub Mar. 10, 2014.
Feng et al., Human L1 retrotransposon encodes a conserved endonuclease required for retrotransposition. Cell. Nov. 29, 1996;87(5):905-16. doi: 10.1016/s0092-8674(00)81997-2.
Ferreira Da Silva et al., Prime editing efficiency and fidelity are enhanced in the absence of mismatch repair. Nat Commun. Feb. 9, 2022;13(1):760. doi: 10.1038/s41467-022-28442-1.
Ferretti et al., Complete genome sequence of an M1 strain of *Streptococcus pyogenes*. Proc Natl Acad Sci U S A. Apr. 10, 2001;98(8):4658-63.
Ferry et al., Rational design of inducible CRISPR guide RNAs for de novo assembly of transcriptional programs. Nat Commun. Mar. 3, 2017;8:14633. doi: 10.1038/ncomms14633.

(56) References Cited

OTHER PUBLICATIONS

Feuk, Inversion variants in the human genome: role in disease and genome architecture. Genome Med. Feb. 12, 2010;2(2):11. doi: 10.1186/gm132.
Filippov et al., A novel type of RNase III family proteins in eukaryotes. Gene. Mar. 7, 2000;245(1):213-21. doi: 10.1016/s0378-1119(99)00571-5.
Filippova et al., Guide RNA modification as a way to improve CRISPR/Cas9-based genome-editing systems. Biochimie. Dec. 2019;167:49-60. doi: 10.1016/j.biochi.2019.09.003. Epub Sep. 4, 2019.
Fine et al., Trans-spliced Cas9 allows cleavage of HBB and CCR5 genes in human cells using compact expression cassettes. Scientific Reports 2015;5(1):Article No. 10777. doi:10.1038/srep10777. With Supplementary Information.
Fire et al., Potent and specific genetic interference by double-stranded RNA in Caenorhabditis elegans. Nature. Feb. 19, 1998;391(6669):806-11. doi: 10.1038/35888.
Fischbach et al., Directed evolution can rapidly improve the activity of chimeric assembly-line enzymes. Proc Natl Acad Sci U S A. Jul. 17, 2007;104(29):11951-6. doi: 10.1073/pnas.0705348104. Epub Jul. 9, 2007.
Fischer et al., Cryptic epitopes induce high-titer humoral immune response in patients with cancer. J Immunol. Sep. 1, 2010;185(5):3095-102. doi: 10.4049/jimmunol.0902166. Epub Jul. 26, 2010.
Fitzjohn, Diversitree: comparative phylogenetic analyses of diversification in R. Methods in Evology and Evolution. Dec. 2012;3(6):1084-92 .doi: 10.1111/j.2041-210X.2012.00234.x.
Flajolet et al., Woodchuck hepatitis virus enhancer I and enhancer II are both involved in—myc2 activation in woodchuck liver tumors. J Virol. Jul. 1998;72(7):6175-80. doi: 10.1128/JVI.72.7.6175-6180.1998.
Flaman et al., A rapid PCR fidelity assay. Nucleic Acids Res. Aug. 11, 1994;22(15):3259-60. doi: 10.1093/nar/22.15.3259.
Flynn et al., CRISPR-mediated genotypic and phenotypic correction of a chronic granulomatous disease mutation in human iPS cells. Exp Hematol. Oct. 2015;43(10):838-848.e3. doi: 10.1016/j.exphem.2015.06.002. Epub Jun. 19, 2015. Including supplementary figures and data.
Fogg et al., New applications for phage integrases. J Mol Biol. Jul. 29, 2014;426(15):2703-16. doi: 10.1016/j.jmb.2014.05.014. Epub May 22, 2014.
Fogg et al., Genome Integration and Excision by a New Streptomyces Bacteriophage, ?Joe. Appl Environ Microbiol. Feb. 15, 2017;83(5):e02767-16. doi: 10.1128/AEM.02767-16.
Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Including Supplementary Information.
Forster et al., Self-cleavage of virusoid RNA is performed by the proposed 55-nucleotide active site. Cell. Jul. 3, 1987;50(1):9-16. doi: 10.1016/0092-8674(87)90657-x.
Fortini et al., Different DNA polymerases are involved in the short-and long-patch base excision repair in mammalian cells. Biochemistry. Mar. 17, 1998;37(11):3575-80. doi: 10.1021/bi972999h.
Fouts et al., Sequencing Bacillus anthracis typing phages gamma and cherry reveals a common ancestry. J Bacteriol. May 2006;188(9):3402-8. doi: 10.1128/JB.188.9.3402-3408.2006.
Freitas et al., Mechanisms and signals for the nuclear import of proteins. Curr Genomics. Dec. 2009;10(8):550-7. doi: 10.2174/138920209789503941.
Freshney, Culture of Animal Cells. A Manual of Basic Technique. Alan R. Liss, Inc. New York. 1983;4.
Fu et al., Improving CRISPR-Cas nuclease specificity using truncated guide RNAs. Nat Biotechnol. Mar. 2014;32(3):279-84. doi: 10.1038/nbt.2808. Epub Jan. 26, 20146.
Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.
Fu et al., Promises and Pitfalls of Intracellular Delivery of Proteins. Bioconjugate Chemistry. Aug. 2014;25:1602-8.
Fuchs et al., Polyarginine as a multifunctional fusion tag. Protein Sci. Jun. 2005;14(6):1538-44.
Fujisawa et al., Disease-associated mutations in CIAS1 induce cathepsin B-dependent rapid cell death of human THP-1 monocytic cells. Blood. Apr. 1, 2007;109(7):2903-11.
Fukui et al., DNA Mismatch Repair in Eukaryotes and Bacteria. J Nucleic Acids. Jul. 27, 2010;2010. pii: 260512. doi: 10.4061/2010/260512.
Fung et al., Repair at single targeted DNA double-strand breaks in pluripotent and differentiated human cells. PLoS One. 2011;6(5):e20514. doi: 10.1371/journal.pone.0020514. Epub May 25, 2011.
Furukawa et al., In vitro selection of allosteric ribozymes that sense the bacterial second messenger c-di-GMP. Methods Mol Biol. 2014;1111:209-20. doi: 10.1007/978-1-62703-755-6_15.
Fusi et al., In Silico Predictive Modeling of CRISPR/Cas9 guide efficiency. Jun. 26, 2015; bioRxiv. http://dx.doi.org/10.1101/021568.
Gaj et al., 3rd. Genome engineering with custom recombinases. Methods Enzymol. 2014;546:79-91. doi: 10.1016/B978-0-12-801185-0.00004-0.
Gaj et al., A comprehensive approach to zinc-finger recombinase customization enables genomic targeting in human cells. Nucleic Acids Res. Feb. 6, 2013;41(6):3937-46.
Gaj et al., Enhancing the specificity of recombinase-mediated genome engineering through dimer interface redesign. J Am Chem Soc. Apr. 2, 2014;136(13):5047-56. doi: 10.1021/ja4130059. Epub Mar. 20, 2014.
Gaj et al., Expanding the scope of site-specific recombinases for genetic and metabolic engineering. Biotechnol Bioeng. Jan. 2014;111(1):1-15. doi: 10.1002/bit.25096. Epub Sep. 13, 2013.
Gaj et al., Structure-guided reprogramming of serine recombinase DNA sequence specificity. Proc Natl Acad Sci US A. Jan. 11, 2011;108(2):498-503. doi: 10.1073/pnas.1014214108. Epub Dec. 27, 2010.
Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.
Gajula, Designing an Elusive CoG?GoC CRISPR Base Editor. Trends Biochem Sci. Feb. 2019;44(2):91-94. doi: 10.1016/j.tibs.2018.10.004. Epub Nov. 13, 2018.
Gallo et al., A novel pathogenic PSEN1 mutation in a family with Alzheimer's disease: phenotypical and neuropathological features. J Alzheimers Dis. 2011;25(3):425-31. doi: 10.3233/JAD-2011-110185.
Gangopadhyay et al., Precision Control of CRISPR-Cas9 Using Small Molecules and Light. Biochemistry. Jan. 29, 2019;58(4):234-244. doi: 10.1021/acs.biochem.8b01202. Epub Jan. 22, 2019.
Gao et al., Cationic liposome-mediated gene transfer. Gene Ther. Dec. 1995;2(10):710-22.
Gao et al., DNA-guided genome editing using the Natronobacterium gregoryi Argonaute. Nat Biotechnol. Jul. 2016;34(7):768-73. doi: 10.1038/nbt.3547. Epub May 2, 2016.
Gao et al., Prime editing in mice reveals the essentiality of a single base in driving tissue-specific gene expression. Genome Biol. Mar. 16, 2021;22(1):83. doi: 10.1186/s13059-021-02304-3.
Gao et al., Self-processing of ribozyme-flanked RNAs into guide RNAs in vitro and in vivo for CRISPR-mediated genome editing. J Integr Plant Biol. Apr. 2014;56(4):343-9. doi: 10.1111/jipb.12152. Epub Mar. 6, 2014.
Gao et al., Treatment of autosomal dominant hearing loss by in vivo delivery of genome editing agents. Nature. Jan. 11, 2018;553(7687):217-221. doi: 10.1038/nature25164. Epub Dec. 20, 2017.
Gapinske et al., CRISPR-SKIP: programmable gene splicing with single base editors. Genome Biol. Aug. 15, 2018;19(1):107. doi: 10.1186/s13059-018-1482-5.
Garcia et al., Transglycosylation: a mechanism for RNA modification (and editing?). Bioorg Chem. Jun. 2005;33(3):229-51. doi: 10.1016/j.bioorg.2005.01.001. Epub Feb. 23, 2005.
Gardlik et al., Vectors and delivery systems in gene therapy. Med Sci Monit. Apr. 2005;11(4):RA110-21. Epub Mar. 24, 2005.

(56) References Cited

OTHER PUBLICATIONS

Garibyan et al., Use of the rpoB gene to determine the specificity of base substitution mutations on the *Escherichia coli* chromosome. DNA Repair (Amst). May 1, 20033;2(5):593-608.
Garneau et al., The CRISPR/Cas bacterial immune system cleaves bacteriophage and plasmid DNA. Nature. Nov. 4, 2010;468(7320):67-71. doi: 10.1038/nature09523.
Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.
Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.
Gaudelli et al., Programmable base editing of AoT to GoC in genomic DNA without DNA cleavage. Nature. Nov. 23, 2017;551(7681):464-471. doi: 10.1038/nature24644. Epub Oct. 25, 2017. Erratum in: Nature. May 2, 2018.
Gearing, Addgene blog. CRISPR 101: Cas9 nickase design and homology directed repair. 2018. pp. 1-12. https://blog.addgene.org/crispr-101-cas9-nickase-design-and-homlogy-directed-repair. Last retrieved online Jun. 25, 2021.
Gehrke et al., An APOBEC3A-Cas9 base editor with minimized bystander and off-target activities. Nat Biotechnol. Nov. 2018;36(10):977-982. doi: 10.1038/nbt.4199. Epub Jul. 30, 2018.
GenBank Accession No. J01600.1. Brooks et al., *E.coli* dam gene coding for DNA adenine methylase. Apr. 26, 1993.
GenBank Accession No. U07651.1. Lu, *Escherichia coli* K12 negative regulator of replication initiation (seqA) gene, complete cds. Jul. 19, 1994.
GenBank Submission; NIH/NCBI Accession No. 4UN5_B. Anders et al., Jul. 23, 2014. 5 pages.
GenBank Submission; NIH/NCBI Accession No. NM_001319224.2. Umar et al., Apr. 21, 2021. 7 pages.
GenBank Submission; NIH/NCBI Accession No. NM_006027.4. Umar et al., Apr. 10, 2021. 7 pages.
GenBank Submission; NIH/NCBI, Accession No. AAA66622.1. Martinelli et al., May 18, 1995. 2 pages.
GenBank Submission; NIH/NCBI, Accession No. AGT42196. Farzadfar et al., Nov. 2, 2013. 2 pages.
GenBank Submission; NIH/NCBI, Accession No. AIT42264.1. Hyun et al., Oct. 15, 2014. 2 pages.
GenBank Submission; NIH/NCBI, Accession No. AKA60242.1. Tong et al., Apr. 5, 2015. 1 page.
GenBank Submission; NIH/NCBI, Accession No. AKQ21048.1. Gilles et al., Jul. 19, 2015. 1 page.
GenBank Submission; NIH/NCBI, Accession No. AKS40380.1. Nodvig et al., Aug. 2, 2015. 1 page.
GenBank Submission; NIH/NCBI, Accession No. APG80656.1. Burstein et al., Dec. 10, 2016. 1 pages.
GenBank Submission; NIH/NCBI, Accession No. AYD60528.1. Ram et al., Oct. 2, 2018. 1 page.
GenBank Submission; NIH/NCBI, Accession No. BDB43378. Zhang et al., Aug. 11, 2016. 2 pages.
GenBank Submission; NIH/NCBI, Accession No. J04623. Kita et al., Apr. 26, 1993. 2 pages.
GenBank Submission; NIH/NCBI, Accession No. KR710351.1. Sahni et al., Jun. 1, 2015. 2 pages.
GenBank Submission; NIH/NCBI, Accession No. NC 002737.2. Nasser et al., Feb. 7, 2021. 2 pages.
GenBank Submission; NIH/NCBI, Accession No. NC_002737.1. Ferretti et al., Jun. 27, 2013. 1 page.
GenBank Submission; NIH/NCBI, Accession No. NC_015683.1. Trost et al., Jul. 6, 2013. 1 page.
GenBank Submission; NIH/NCBI, Accession No. NC_016782.1. Trost et al., Jun. 11, 2013. 1 page.
GenBank Submission; NIH/NCBI, Accession No. NC_016786.1. Trost et al., Aug. 28, 2013. 1 page.
GenBank Submission; NIH/NCBI, Accession No. NC_017053.1. Fittipaldi et al., Jul. 6, 2013. 1 page.
GenBank Submission; NIH/NCBI, Accession No. NC_017317.1. Trost et al., Jun. 11, 2013. 1 page.
GenBank Submission; NIH/NCBI, Accession No. NC_017861.1. Heidelberg et al., Jun. 11, 2013. 1 page.
GenBank Submission; NIH/NCBI, Accession No. NC_018010.1. Lucas et al., Jun. 11, 2013. 2 pages.
Genbank Submission; NIH/NCBI, Accession No. NC_018721.1. Feng et al., Jun. 11, 2013. 1 pages.
GenBank Submission; NIH/NCBI, Accession No. NC_021284.1. Ku et al., Jul. 12, 2013. 1 page.
GenBank Submission; NIH/NCBI, Accession No. NC_021314.1. Zhang et al., Jul. 15, 2013. 1 page.
GenBank Submission; NIH/NCBI, Accession No. NC_021846.1. Lo et al., Jul. 22, 2013. 1 page.
GenBank Submission; NIH/NCBI, Accession No. NG_008692.2. McClintock et al., Aug. 27, 2018. 33 pages.
GenBank Submission; NIH/NCBI, Accession No. NM_000311.5. Alves et al., Mar. 7, 2021. 5 pages.
GenBank Submission; NIH/NCBI, Accession No. NM_001319224. Umar et al., Apr. 21, 2021. 7 pages.
GenBank Submission; NIH/NCBI, Accession No. NM_002945.3. Weiser et al., Sep. 3, 2017. 5 pages.
GenBank Submission; NIH/NCBI, Accession No. NM_002946.5. Kavli et al., Jun. 26, 2021. 5 pages.
GenBank Submission; NIH/NCBI, Accession No. NM_002947.4. Xiao et al., May 1, 2019. 4 pages.
GenBank Submission; NIH/NCBI, Accession No. NM_003686. Umar et al., Apr. 9, 2021. 7 pages.
GenBank Submission; NIH/NCBI, Accession No. NM_003686.4. Umar et al., Apr. 9, 2021. 7 pages.
GenBank Submission; NIH/NCBI, Accession No. NM_006027. Umar et al., Apr. 10, 2021. 7 pages.
GenBank Submission; NIH/NCBI, Accession No. NM_174936. Guo et al., Oct. 28, 2015. 6 pages.
GenBank Submission; NIH/NCBI, Accession No. NP_000302.1. Alves et al., Mar. 7, 2021. 4 pages.
GenBank Submission; NIH/NCBI, Accession No. NP_001075493.1. Schiaffella et al., Jun. 24, 2018. 2 pages.
GenBank Submission; NIH/NCBI, Accession No. NP_001157741.1. Zeng et al., Sep. 17, 2018. 3 pages.
GenBank Submission; NIH/NCBI, Accession No. NP_001157742.1. Zeng et al., Oct. 21, 2018. 3 pages.
GenBank Submission; NIH/NCBI, Accession No. NP_001243439.1. Lee et al., Jul. 26, 2021. 4 pages.
GenBank Submission; NIH/NCBI, Accession No. NP_033040.2. Liu et al., Jun. 23, 2018. 2 pages.
GenBank Submission; NIH/NCBI, Accession No. NP_076161.2. Wade et al., Jun. 20, 2021. 4 pages.
GenBank Submission; NIH/NCBI, Accession No. NP_358988.1. Hoskins et al., Jan. 11, 2017. 2 pages.
GenBank Submission; NIH/NCBI, Accession No. NP_391970.1. Borriss et al., Feb. 12, 2021. 3 pages.
GenBank Submission; NIH/NCBI, Accession No. NP_472073.1. Glaser et al., Jun. 27, 2013. 2 pages.
GenBank Submission; NIH/NCBI, Accession No. NP_628093.1. Hsiao et al., Aug. 3, 2016. 2 pages.
GenBank Submission; NIH/NCBI, Accession No. NP_955579.1. Chen et al., Aug. 13, 2018. 5 pages.
GenBank Submission; NIH/NCBI, Accession No. P42212. Prasher et al., Mar. 19, 2014. 7 pages.
GenBank Submission; NIH/NCBI, Accession No. QBJ66766. Duan et al. Aug. 12, 2020. 2 pages.
GenBank Submission; NIH/NCBI, Accession No. RFF81513.1. Zhou et al., Aug. 21, 2018. 2 pages.
GenBank Submission; NIH/NCBI, Accession No. SNX31424.1. Weckx, S., Feb. 16, 2018. 2 pages.
GenBank Submission; NIH/NCBI, Accession No. TGH57013. Xu et al., Apr. 9, 2019. 2 pages.
GenBank Submission; NIH/NCBI, Accession No. WP_002989955.1. No Author Listed, May 6, 2013. 1 page.

(56) References Cited

OTHER PUBLICATIONS

GenBank Submission; NIH/NCBI, Accession No. WP_010922251.1. No Author Listed, May 15, 2013. 1 page.
GenBank Submission; NIH/NCBI, Accession No. WP_011054416.1. No Author Listed, May 15, 2013. 1 page.
GenBank Submission; NIH/NCBI, Accession No. WP_011284745.1. No Author Listed, May 16, 2013. 1 page.
GenBank Submission; NIH/NCBI, Accession No. WP_011285506.1. No Author Listed, May 16, 2013. 1 page.
GenBank Submission; NIH/NCBI, Accession No. WP_011527619.1. No Author Listed, May 16, 2013. 1 page.
GenBank Submission; NIH/NCBI, Accession No. WP_012560673.1. No Author Listed, May 17, 2013. 1 page.
GenBank Submission; NIH/NCBI, Accession No. WP_014407541.1. No Author Listed, May 18, 2013. 1 page.
GenBank Submission; NIH/NCBI, Accession No. WP_016631044.1. Haft et al., Sep. 22, 2020. 1 page.
GenBank Submission; NIH/NCBI, Accession No. WP_020905136.1. No Author Listed, Jul. 25, 2013. 1 page.
GenBank Submission; NIH/NCBI, Accession No. WP_023080005.1. No Author Listed, Oct. 27, 2013. 1 page.
GenBank Submission; NIH/NCBI, Accession No. WP_023610282.1. No Author Listed, Nov. 27, 2013. 1 page.
GenBank Submission; NIH/NCBI, Accession No. WP_030125963.1. No Author Listed, Jul. 9, 2014. 1 page.
GenBank Submission; NIH/NCBI, Accession No. WP_030126706.1. No Author Listed, Jul. 9, 2014. 1 page.
GenBank Submission; NIH/NCBI, Accession No. WP_031386437.1. No Author Listed., Sep. 23, 2019. 1 page.
GenBank Submission; NIH/NCBI, Accession No. WP_031488318.1. No Author Listed., Aug. 5, 2014. 1 page.
GenBank Submission; NIH/NCBI, Accession No. WP_031589969.1. Haft et al., Oct. 9, 2019. 2 pages.
GenBank Submission; NIH/NCBI, Accession No. WP_032460140.1. No Author Listed, Oct. 4, 2014. 1 page.
GenBank Submission; NIH/NCBI, Accession No. WP_032461047.1. No Author Listed, Oct. 4, 2014. 1 page.
GenBank Submission; NIH/NCBI, Accession No. WP_032462016.1. Haft et al., Oct. 4, 2014. 1 page.
GenBank Submission; NIH/NCBI, Accession No. WP_032462936.1. No Author Listed, Oct. 4, 2014. 1 page.
GenBank Submission; NIH/NCBI, Accession No. WP_032464890.1. No Author Listed, Oct. 4, 2014. 1 page.
GenBank Submission; NIH/NCBI, Accession No. WP_038431314.1. No Author Listed, Dec. 26, 2014. 1 page.
GenBank Submission; NIH/NCBI, Accession No. WP_038432938.1. No Author Listed, Dec. 26, 2014. 1 page.
GenBank Submission; NIH/NCBI, Accession No. WP_038434062.1. No Author Listed, Dec. 26, 2014. 1 page.
GenBank Submission; NIH/NCBI, Accession No. WP_044924278.1. Haft et al., Oct. 9, 2019. 2 pages.
GenBank Submission; NIH/NCBI, Accession No. WP_047338501.1. Haft et al., Oct. 9, 2019. 2 pages.
GenBank Submission; NIH/NCBI, Accession No. WP_048327215.1. No Author Listed, Jun. 26, 2015. 1 page.
GenBank Submission; NIH/NCBI, Accession No. WP_049519324.1. No Author Listed, Jul. 20, 2015. 1 page.
GenBank Submission; NIH/NCBI, Accession No. WP_060798984.1. Haft et al., Oct. 9, 2019. 2 pages.
GenBank Submission; NIH/NCBI, Accession No. WP_062913273.1. Haft et al., Oct. 9, 2019, 2 pages.
GenBank Submission; NIH/NCBI, Accession No. WP_072754838. No Author Listed., Sep. 23, 2019. 1 page.
GenBank Submission; NIH/NCBI, Accession No. WP_095142515.1. No Author Listed., Sep. 23, 2019. 1 page.
GenBank Submission; NIH/NCBI, Accession No. WP_118538418.1. No Author Listed., Oct. 13, 2019. 1 page.
GenBank Submission; NIH/NCBI, Accession No. WP_119223642.1. No Author Listed., Oct. 13, 2019. 1 page.
GenBank Submission; NIH/NCBI, Accession No. WP_119227726.1. No Author Listed., Oct. 13, 2019. 1 page.
GenBank Submission; NIH/NCBI, Accession No. WP_119623382.1. No Author Listed., Oct. 13, 2019. 1 page.
GenBank Submission; NIH/NCBI, Accession No. WP_132221894.1. No Author Listed., Sep. 23, 2019. 1 page.
GenBank Submission; NIH/NCBI, Accession No. WP_133478044.1. Haft et al., Oct. 9, 2019. 2 pages.
GenBank Submission; NIH/NCBI, Accession No. XP_003314669.1. No Author Listed, Mar. 20, 2018. 2 pages.
GenBank Submission; NIH/NCBI, Accession No. XP_026671085.1. No Author Listed, Oct. 17, 2018. 1 page.
GenBank Submission; NIH/NCBI, Accession No. YP_002004532.1. Villegas et al., Oct. 11, 2021. 2 pages.
GenBank Submission; NIH/NCBI, Accession No. YP_002342100.1. Bernardini et al., Jun. 10, 2013. 2 pages.
GenBank Submission; NIH/NCBI, Accession No. YP_002344900.1. Gundogdu et al., Mar. 19, 2014. 2 pages.
GenBank Submission; NIH/NCBI, Accession No. YP_006589943.1. Lynch et al., Oct. 15, 2021. 2 pages.
GenBank Submission; NIH/NCBI, Accession No. YP_009137104.1. Davison, Aug. 13, 2018. 2 pages.
GenBank Submission; NIH/NCBI, Accession No. YP_009283008.1. Bernardini et al., Sep. 23, 2016. 2 pages.
GenBank Submission; NIH/NCBI, Accession No. YP_820832.1. Makarova et al., Aug. 27, 2013. 2 pages.
George et al., Adenosine deaminases acting on RNA, RNA editing, and interferon action. J Interferon Cytokine Res. Jan. 2011;31(1):99-117. doi: 10.1089/jir.2010.0097. Epub Dec. 23, 2010. PMID: 21182352; PMCID: PMC3034097.
Gerard et al., Influence on stability in *Escherichia coli* of the carboxy-terminal structure of cloned Moloney murine leukemia virus reverse transcriptase. DNA. Aug. 1986;5(4):271-9. doi: 10.1089/dna.1986.5.271.
Gerard et al., Purification and characterization of the DNA polymerase and RNase H activities in Moloney murine sarcoma-leukemia virus. J Virol. Apr. 1975;15(4):785-97. doi: 10.1128/JVI.15.4.785-797.1975.
Gerard et al., The role of template-primer in protection of reverse transcriptase from thermal inactivation. Nucleic Acids Res. Jul. 15, 2002;30(14):3118-29. doi: 10.1093/nar/gkf417.
Gerber et al., An adenosine deaminase that generates inosine at the wobble position of tRNAs. Science. Nov. 5, 1999;286(5442):1146-9. doi: 10.1126/science.286.5442.1146.
Gerber et al., RNA editing by base deamination: more enzymes, more targets, new mysteries. Trends Biochem Sci. Jun. 2001;26(6):376-84.
Gersbach et al., Directed evolution of recombinase specificity by split gene reassembly. Nucleic Acids Res. Jul. 2010;38(12):4198-206. doi: 10.1093/nar/gkq125. Epub Mar. 1, 2010.
Gersbach et al., Targeted plasmid integration into the human genome by an engineered zinc-finger recombinase. Nucleic Acids Res. Sep. 1, 2011;39(17):7868-78. doi: 10.1093/nar/gkr421. Epub Jun. 7, 2011.
Gete et al., Mechanisms of angiogenic incompetence in Hutchinson-Gilford progeria via downregulation of endothelial NOS. Aging Cell. Jul. 2021;20(7):e13388. doi: 10.1111/acel.13388. Epub Jun. 4, 2021.
Ghahfarokhi et al., Blastocyst Formation Rate and Transgene Expression are Associated with Gene Insertion into Safe and Non-Safe Harbors in the Cattle Genome. Sci Rep. Nov. 13, 2017;7(1):15432. doi: 10.1038/s41598-017-15648-3.
Gibson et al., Enzymatic assembly of DNA molecules up to several hundred kilobases. Nat Methods. May 2009;6(5):343-5. doi: 10.1038/nmeth.1318. Epub Apr. 12, 2009.
Gil, Position-dependent sequence elements downstream of AAUAAA are required for efficient rabbit beta-globin mRNA 3' end formation. Cell. May 8, 1987;49(3):399-406. doi: 10.1016/0092-8674(87)90292-3.
Gilbert et al., CRISPR-mediated modular RNA-guided regulation of transcription in eukaryotes. Cell. 2013 154(2):442-51.

(56) References Cited

OTHER PUBLICATIONS

Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 2, 20133.
Glasgow et al.,DNA-binding properties of the Hin recombinase. J Biol Chem. Jun. 15, 1989;264(17):10072-82.
Glassner et al., Generation of a strong mutator phenotype in yeast by imbalanced base excision repair. Proc Natl Acad Sci U S A. Aug. 18, 1998;95(17):9997-10002.
Goldberg et al., Epigenetics: a landscape takes shape. Cell. Feb. 23, 2007;128(4):635-8. doi: 10.1016/j.cell.2007.02.006.
Goldberg et al., Loss-of-function mutations in the Nav1.7 gene underlie congenital indifference to pain in multiple human populations. Clin Genet. Apr. 2007;71(4):311-9. doi: 10.1111/j.1399-0004.2007.00790.x.
Gong et al., Active DNA demethylation by oxidation and repair. Cell Res. Dec. 2011;21(12):1649-51. doi: 10.1038/cr.2011.140. Epub Aug. 23, 2011.
Gonzalez et al., An iCRISPR platform for rapid, multiplexable, and inducible genome editing in human pluripotent stem cells. Cell Stem Cell. Aug. 7, 2014;15(2):215-26. doi: 10.1016/j.stem.2014.05.018. Epub Jun. 12, 2014.
Goodnough et al., Development of a delivery vehicle for intracellular transport of botulinum neurotoxin antagonists. FEBS Lett. Feb. 27, 2002;513(2-3):163-8.
Gordley et al., Evolution of programmable zinc finger-recombinases with activity in human cells. J Mol Biol. Mar. 30, 2007;367(3):802-13. Epub Jan. 12, 2007.
Gordley et al., Synthesis of programmable integrases. Proc Natl Acad Sci U S A. Mar. 31, 2009;106(13):5053-8. doi: 10.1073/pnas.0812502106. Epub Mar. 12, 2009.
Gou et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Grainge et al., The integrase family of recombinase: organization and function of the active site. Mol Microbiol. Aug. 1999;33(3):449-56.
Gregory et al., Integration site for Streptomyces phage phiBT1 and development of site-specific integrating vectors. J Bacteriol. Sep. 2003;185(17):5320-3. doi: 10.1128/jb.185.17.5320-5323.2003.
Griffiths, Endogenous retroviruses in the human genome sequence. Genome Biol. 2001;2(6):Reviews1017. doi: 10.1186/GB-2001-2-6-reviews1017. Epub Jun. 5, 2001.
Grindley et al., Mechanisms of site-specific recombination. Annu Rev Biochem. 2006;75:567-605. doi: 10.1146/annurev.biochem.73.011303.073908.
Grishok et al., Genes and Mechanisms Related to RNA Interference Regulate Expression of the Small Temporal RNAs that Control C. elegans Developmental Timing. Jul. 13, 2001:106(1):P23-4.
Groher et al., Synthetic riboswitches—A tool comes of age. Biochim Biophys Acta. Oct. 2014;1839(10):964-973. doi: 10.1016/j.bbagrm.2014.05.005. Epub May 17, 2014.
Groth et al., Construction of transgenic *Drosophila* by using the site-specific integrase from phage phiC31. Genetics. Apr. 2004;166(4):1775-82. doi: 10.1534/genetics.166.4.1775.
Groth et al., Phage integrases: biology and applications. J Mol Biol. Jan. 16, 2004;335(3):667-78.
Gruber et al., Strategies for measuring evolutionary conservation of RNA secondary structures. BMC Bioinformatics. Feb. 26, 2008;9:122. doi: 10.1186/1471-2105-9-122.
Gruber et al., The Vienna RNA websuite. Nucleic Acids Res. Jul. 1, 2008;36(Web Server issue):W70-4. doi: 10.1093/nar/gkn188. Epub Apr. 19, 2008.
Grunebaum et al., Recent advances in understanding and managing adenosine deaminase and purine nucleoside phosphorylase deficiencies. Curr Opin Allergy Clin Immunol. Dec. 2013;13(6):630-8. doi: 10.1097/ACI.0000000000000006.
Grünewald et al., Transcriptome-wide off-target RNA editing induced by CRISPR-guided DNA base editors. Nature. May 2019;569(7756):433-437. doi: 10.1038/s41586-019-1161-z. Epub Apr. 17, 2019.
Guedon et al., Current gene therapy using viral vectors for chronic pain. Mol Pain. May 13, 2015;11:27. doi: 10.1186/s12990-015-0018-1.
Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.
Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.
Gumulya et al., Exploring the past and the future of protein evolution with ancestral sequence reconstruction: the 'retro' approach to protein engineering. Biochem J. Jan. 1, 2017;474(1):1-19. doi: 10.1042/BCJ20160507.
Guo et al., Designing single guide RNA for CIRSPR-Cas9 base editor by deep learning. Peer reviewed Thesis/Dissertation. UCLA Electronic Theses and Dissertations. Jan. 1, 2019. Retrieved from the Internet via https://escholarship.org/uc/item/7vf9z54t. Last accessed on Apr. 29, 2021.
Guo et al., Evolution of Tetrahymena ribozyme mutants with increased structural stability. Nat Struct Biol. Nov. 2002;9(11):855-61. doi: 10.1038/nsb850.
Guo et al., Facile functionalization of FK506 for biological studies by the thiol-ene 'click' reaction. RSC Advances. 2014;22:11400-3.
Guo et al., Protein tolerance to random amino acid change. Proc Natl Acad Sci U S A. Jun. 22, 2004;101(25):9205-10. Epub Jun. 14, 2004.
Guo et al., Structure of Cre recombinase complexed with DNA in a site-specific recombination synapse. Nature. Sep. 4, 1997;389(6646):40-6.
Gupta et al., Cross-talk between cognate and noncognate RpoE sigma factors and Zn(2+)-binding anti-sigma factors regulates photooxidative stress response in Azospirillum brasilense. Antioxid Redox Signal. Jan. 1, 2014;20(1):42-59. doi: 10.1089/ars.2013.5314. Epub Jul. 19, 2013.
Gupta et al., Sequences in attB that affect the ability of phiC31 integrase to synapse and to activate DNA cleavage. Nucleic Acids Res. 2007;35(10):3407-19. doi: 10.1093/nar/gkm206. Epub May 3, 2007.
Gutschner et al., Post-translational Regulation of Cas9 during G1 Enhances Homology-Directed Repair. Cell Rep. Feb. 16, 2016;14(6):1555-1566. doi: 10.1016/j.celrep.2016.01.019. Epub Feb. 4, 2016.
Guzman et al., Tight regulation, modulation, and high-level expression by vectors containing the arabinose PBAD promoter. J Bacteriol. 1995;177(14):4121-4130.
Haapaniemi et al., CRISPR-Cas9 genome editing induces a p53-mediated DNA damage response. Nat Med. Jul. 2018;24(7):927-930. doi: 10.1038/s41591-018-0049-z. Epub Jun. 11, 2018.
Haddada et al., Gene therapy using adenovirus vectors. Curr Top Microbiol Immunol. 1995;199 ( Pt 3):297-306. doi: 10.1007/978-3-642-79586-2_14.
Haeussler et al., Evaluation of off-target and on-target scoring algorithms and integration into the guide RNA selection tool CRISPOR. Genome Biol. Jul. 5, 2016;17(1):148. doi: 10.1186/s13059-016-1012-2.
Halbert et al., Repeat transduction in the mouse lung by using adeno-associated virus vectors with different serotypes. J Virol. Feb. 2000;74(3):1524-32. doi: 10.1128/jvi.74.3.1524-1532.2000.
Hale et al., RNA-guided RNA cleavage by a CRISPR RNA-Cas protein complex. Cell. Nov. 25, 2009;139(5):945-56. doi: 10.1016/j.cell.2009.07.040.
Halmai et al., Targeted CRIPSR/dCas9-mediated reactivation of epigenetically silenced genes suggests limited escape from the inactive X chromosome. 2nd Intl Conf on Epigenetics and Bioengineering. Oct. 4, 2018; Retrieved from the Internet: https://aiche.confex.com/aiche/epibio18/webprogram/paper544785.html. Retrieved Jun. 29, 2020.

(56) References Cited

OTHER PUBLICATIONS

Halperin et al., CRISPR-guided DNA polymerases enable diversification of all nucleotides in a tunable window. Nature. Aug. 2018;560(7717):248-252. doi: 10.1038/s41586-018-0384-8. Epub Aug. 1, 2018.
Halvas et al., Role of murine leukemia virus reverse transcriptase deoxyribonucleoside triphosphate-binding site in retroviral replication and in vivo fidelity. J Virol. Nov. 2000;74(22):10349-58. doi: 10.1128/jvi.74.22.10349-10358.2000.
Hamano-Takaku et al., A mutant *Escherichia coli* tyrosyl-tRNA synthetase utilizes the unnatural amino acid azatyrosine more efficiently than tyrosine. J Biol Chem. Dec. 22, 2000;275(51):40324-8.
Han, New CRISPR/Cas9-based Tech Edits Single Nucleotides Without Breaking DNA. Genome Web, Apr. 20, 2016. https://www.genomeweb.com/gene-silencinggene-editing/new-crisprcas9-based-tech-edits-single-nucleotides-without-breaking-dna, pp. 1-3.
Handa et al., Template-assisted synthesis of adenine-mutagenized cDNA by a retroelement protein complex. Nucleic Acids Res. Oct. 12, 2018;46(18):9711-9725. doi: 10.1093/nar/gky620.
Hanna et al., Massively parallel assessment of human variants with base editor screens. Cell. Feb. 18, 2021;184(4):1064-1080.e20. doi: 10.1016/j.cell.2021.01.012.
Hanson et al., Codon optimality, bias and usage in translation and mRNA decay. Nat Rev Mol Cell Biol. Jan. 2018; 19(1):20-30. doi: 10.1038/nrm.2017.91. Epub Oct. 11, 2017.
Hardt et al.,Missense variants in hMLH1 identified in patients from the German HNPCC consortium and functional studies. Fam Cancer. Jun. 2011;10(2):273-84. doi: 10.1007/s10689-011-9431-4.
Harms et al., Evolutionary biochemistry: revealing the historical and physical causes of protein properties. Nat Rev Genet. Aug. 2013;14(8):559-71. doi: 10.1038/nrg3540.
Harmsen et al., DNA mismatch repair and oligonucleotide end-protection promote base-pair substitution distal from a CRISPR/Cas9-induced DNA break. Nucleic Acids Res. Apr. 6, 2018;46(6):2945-2955. doi: 10.1093/nar/gky076.
Harrington et al., A thermostable Cas9 with increased lifetime in human plasma. Nat Commun. Nov. 10, 2017;8(1):1424. doi: 10.1038/s41467-017-01408-4. Posted May 16, 2017 as bioRxiv preprint. Doi.org/10.1101/138867.
Harris et al., RNA Editing Enzyme APOBEC1 and Some of Its Homologs Can Act as DNA Mutators. Mol Cell. Nov. 2002; 10(5):1247-53.
Hartung et al., Correction of metabolic, craniofacial, and neurologic abnormalities in MPS I mice treated at birth with adeno-associated virus vector transducing the human alpha-L-iduronidase gene. Mol Ther. Jun. 2004;9(6):866-75.
Hartung et al., Cre mutants with altered DNA binding properties. J Biol Chem. Sep. 4, 1998;273(36):22884-91.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hasegawa et al., Spontaneous mutagenesis associated with nucleotide excision repair in *Escherichia coli*. Genes Cells. May 2008;13(5):459-69. doi: 10.1111/j.1365-2443.2008.01185.x.
Hayes et al., Stop codons preceded by rare arginine codons are efficient determinants of SsrA tagging in *Escherichia coli*. Proc Natl Acad Sci U S A. Mar. 19, 2002;99(6):3440-5. Epub Mar. 12, 2002.
Hector et al., CDKL5 variants: Improving our understanding of a rare neurologic disorder. Neurol Genet. Dec. 15, 2017;3(6):e200. doi: 10.1212/NXG.0000000000000200.
Heidenreich et al., Non-homologous end joining as an important mutagenic process in cell cycle-arrested cells. EMBO J. May 1, 2003;22(9):2274-83. doi: 10.1093/emboj/cdg203.
Held et al., In vivo correction of murine hereditary tyrosinemia type I by phiC31 integrase-mediated gene delivery. Mol Ther. Mar. 2005;11(3):399-408. doi: 10.1016/j.ymthe.2004.11.001.
Heller et al., Replisome assembly and the direct restart of stalled replication forks. Nat Rev Mol Cell Biol. Dec. 2006;7(12):932-43. Epub Nov. 8, 2006.
Hendricks et al., The *S. cerevisiae* Mag1 3-methyladenine DNA glycosylase modulates susceptibility to homologous recombination. DNA Repair (Amst). 2002;1(8):645-659.
Hermonat et al., Use of adeno-associated virus as a mammalian DNA cloning vector: transduction of neomycin resistance into mammalian tissue culture cells. Proc Natl Acad Sci U S A. Oct. 1984;81(20):6466-70. doi: 10.1073/pnas.81.20.6466.
Herschhorn et al., Retroviral reverse transcriptases. Cell Mol Life Sci. Aug. 2010;67(16):2717-47. doi: 10.1007/s00018-010-0346-2. Epub Apr. 1, 2010.
Herzig et al., A Novel Leu92 Mutant of HIV-1 Reverse Transcriptase with a Selective Deficiency in Strand Transfer Causes a Loss of Viral Replication. J Virol. Aug. 2015;89(16):8119-29. doi: 10.1128/JVI.00809-15. Epub May 20, 2015.
Hess et al., Directed evolution using dCas9-targeted somatic hypermutation in mammalian cells. Nat Methods. Dec. 2016;13(12):1036-1042. doi: 10.1038/nmeth.4038. Epub Oct. 31, 2016.
Hickford et al., Antitumour polyether macrolides: four new halichondrins from the New Zealand deep-water marine sponge Lissodendoryx sp. Bioorg Med Chem. Mar. 15, 2009;17(6):2199-203. doi: 10.1016/j.bmc.2008.10.093. Epub Nov. 19, 2008.
Hida et al., Directed evolution for drug and nucleic acid; delivery. Adv Drug Deliv Rev. Dec. 22, 2007;59(15):1562-78. Epub Aug. 28, 2007.
Higgs et al., Genetic complexity in sickle cell disease. Proc Natl Acad Sci U S A. Aug. 19, 2008;105(33):11595-6. doi: 10.1073/pnas.0806633105. Epub Aug. 11, 2008.
Hilbers et al., New developments in structure determination of pseudoknots. Biopolymers. 1998;48(2-3):137-53. doi: 10.1002/(SICI)1097-0282(1998)48:2<137::AID-BIP4>3.0.CO;2-H.
Hill et al., Functional analysis of conserved histidines in ADP-glucose pyrophosphorylase from *Escherichia coli*.Biochem Biophys Res Commun. Mar. 17, 1998;244(2):573-7.
Hille et al., The Biology of CRISPR-Cas: Backward and Forward. Cell. Mar. 8, 2018;172(6):1239-1259. doi: 10.1016/j.cell.2017.11.032.
Hilton et al., Enabling functional genomics with genome engineering. Genome Res. Oct. 2015;25(10):1442-55. doi: 10.1101/gr.190124.115.
Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.
Hirano et al., Structural Basis for the Altered PAM Specificities of Engineered CRISPR-Cas9. Mol Cell. Mar. 17, 2016;61(6):886-94. doi: 10.1016/j.molcel.2016.02.018.
Hoang et al., UFBoot2: Improving the Ultrafast Bootstrap Approximation. Mol Biol Evol. Feb. 1, 2018;35(2):518-522. doi: 10.1093/molbev/msx281.
Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.
Hockemeyer et al., Genetic engineering of human pluripotent cells using TALE nucleases. Nat Biotechnol. Jul. 7, 2011;29(8):731-4. doi: 10.1038/nbt.1927.
Hoernes et al., Translating the epitranscriptome. Wiley Interdiscip Rev RNA. Jan. 2017;8(1):e1375. doi: 10.1002/wrna.1375. Epub Jun. 2, 20167.
Hoess et al., DNA specificity of the Cre recombinase resides in the 25 kDa carboxyl domain of the protein. J Mol Biol. Dec. 20, 1990;216(4):873-82. doi: 10.1016/S0022-2836(99)80007-2.
Holden et al., Crystal structure of the anti-viral APOBEC3G catalytic domain and functional implications. Nature. Nov. 6, 2008;456(7218):121-4. doi: 10.1038/nature07357. Epub Oct. 12, 2008.
Hollis et al., Phage integrases for the construction and manipulation of transgenic mammals. Reprod Biol Endocrinol. Nov. 7, 2003;1:79. doi: 10.1186/1477-7827-1-79.
Holsinger et al., Signal transduction in T lymphocytes using a conditional allele of Sos. Proc Natl Acad Sci U S A. Oct. 10, 1995;92(21):9810-4. doi: 10.1073/pnas.92.21.9810.

(56) References Cited

OTHER PUBLICATIONS

Holt et al., Human hematopoietic stem/progenitor cells modified by zinc-finger nucleases targeted to CCR5 control HIV-1 in vivo. Nat Biotechnol. Aug. 2010;28(8):839-47. doi: 10.1038/nbt.1663. Epub Jul. 2, 2010.

Hondares et al., Peroxisome Proliferator-activated Receptor ? (PPAR?) Induces PPAR? Coactivator 1? (PGC-1?) Gene Expression and Contributes to Thermogenic Activation of Brown Fat. J Biol. Chem Oct. 2011; 286(50):43112-22. doi: 10.1074/jbc.M111.252775.

Hoogenboom et al., Natural and designer binding sites made by phage display technology. Immunol Today. Aug. 2000;21(8):371-8.

Horvath et al., CRISPR/Cas, the immune system of bacteria and archaea. Science. Jan. 8, 2010;327(5962):167-70. doi: 10.1126/science.1179555.

Horvath et al., Diversity, Activity, and Evolution of CRISPR Loci in *Streptococcus thermophilus*. J Bacteriol. Feb. 2008;190(4):1401-12. doi: 10.1128/JB.01415-07. Epub Dec. 7, 2007.

Hotta et al., [Neurotropic viruses—classification, structure and characteristics]. Nihon Rinsho. Apr. 1997;55(4):777-82. Japanese.

Hou et al., Efficient genome engineering in human pluripotent stem cells using Cas9 from Neisseria meningitidis. Proc Natl Acad Sci U S A. Sep. 24, 2013;110(39):15644-9. doi: 10.1073/pnas.1313587110. Epub Aug. 12, 2013.

Houdebine, The methods to generate transgenic animals and to control transgene expression. J Biotechnol. Sep. 25, 2002;98(2-3):145-60.

Housden et al., Identification of potential drug targets for tuberous sclerosis complex by synthetic screens combining CRISPR-based knockouts with RNAi. Sci Signal. Sep. 8, 2015;8(393):rs9. doi: 10.1126/scisignal.aab3729.

Howard et al., Intracerebral drug delivery in rats with lesion-induced memory deficits. J Neurosurg. Jul. 1989;71(1):105-12.

Hower et al., Shape-based peak identification for ChIP-Seq. BMC Bioinformatics. Jan. 12, 2011;12:15. doi: 10.1186/1471-2105-12-15.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013. Supplementary Information. 27 pages.

Hsu et al., PrimeDesign software for rapid and simplified design of prime editing guide RNAs. Nat Commun. Feb. 15, 2021;12(1):1034. doi: 10.1038/s41467-021-21337-7.

Hu et al., Chemical Biology Approaches to Genome Editing: Understanding, Controlling, and Delivering Programmable Nucleases. Cell Chem Biol. Jan. 21, 2016;23(1):57-73. doi: 10.1016/j.chembiol.2015.12.009.

Hu et al., Evolved Cas9 variants with broad PAM compatibility and high DNA specificity. Nature. Apr. 5, 2018;556(7699):57-63 and Extended/Supplementary Data. doi: 10.1038/nature26155. Epub Feb. 28, 2018. 21 pages.

Hu et al., Evolved Cas9 variants with broad PAM compatibility and high DNA specificity. Nature. Apr. 5, 2018;556(7699):57-63. doi: 10.1038/nature26155. Epub Feb. 28, 2018.

Hua et al., Expanding the base editing scope in rice by using Cas9 variants. Plant Biotechnol J. Feb. 2019;17(2):499-504. doi: 10.1111/pbi.12993. Epub Oct. 5, 2018.

Hua et al., Precise A.T to G.C Base Editing in the Rice Genome. Mol Plant. Apr. 2, 2018;11(4):627-630. doi: 10.1016/j.molp.2018.02.007. Epub Feb. 21, 2018.

Huang et al., Circularly permuted and PAM-modified Cas9 variants broaden the targeting scope of base editors. Nat Biotechnol. Jun. 2019;37(6):626-631. doi: 10.1038/s41587-019-0134-y. Epub May 20, 2019. Including Supplementary Information.

Huang et al., Heritable gene targeting in zebrafish using customized TALENs. Nat Biotechnol. Aug. 5, 2011;29(8):699-700. doi: 10.1038/nbt.1939.

Huang et al., Precision genome editing using cytosine and adenine base editors in mammalian cells. Nat Protoc. Feb. 2021;16(2):1089-1128. doi: 10.1038/s41596-020-00450-9. Epub Jan. 18, 2021.

Huggins et al., Flap endonuclease 1 efficiently cleaves base excision repair and DNA replication intermediates assembled into nucleosomes. Mol Cell. Nov. 2002;10(5):1201-11. doi: 10.1016/s1097-2765(02)00736-0.

Humbert et al., Targeted gene therapies: tools, applications, optimization. Crit Rev Biochem Mol Biol. May-Jun. 2012;47(3):264-81. doi: 10.3109/10409238.2012.658112.

Hung et al., Protein localization in disease and therapy. J Cell Sci. Oct. 15, 2011;124(Pt 20):3381-92. doi: 10.1242/jcs.089110.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Husimi, Selection and evolution of bacteriophages in cellstat. Adv Biophys. ; 1989;25:1-43.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Hwang et al., Efficient In Vivo Genome Editing Using RNA-Guided Nucleases. Nat Biotechnol. Mar. 2013;31(3):227-229. doi: 10.1038/nbt.2501. Epub Jan. 29, 2013.

Hwang et al., Web-based design and analysis tools for CRISPR base editing. BMC Bioinformatics. Dec. 27, 2018;19(1):542. doi: 10.1186/s12859-018-2585-4.

Ibba et al., Relaxing the substrate specificity of an aminoacyl-tRNA synthetase allows in vitro and in vivo synthesis of proteins containing unnatural amino acids. FEBS Lett. May 15, 1995;364(3):272-5.

Ibba et al., Substrate specificity is determined by amino acid binding pocket size in *Escherichia coli* phenylalanyl-tRNA synthetase. Biochemistry. Jun. 14, 1994;33(23):7107-12.

Ihry et al., p53 inhibits CRISPR-Cas9 engineering in human pluripotent stem cells. Nat Med. Jul. 2018;24(7):939-946. doi: 10.1038/s41591-018-0050-6. Epub Jun. 11, 2018.

Iida et al., A site-specific, conservative recombination system carried by bacteriophage P1. Mapping the recombinase gene cin and the cross-over sites cix for the inversion of the C segment. EMBO J. 1982;1(11):1445-53.

Iida et al., The Min DNA inversion enzyme of plasmid p15B of *Escherichia coli* 15T-: a new member of the Din family of site-specific recombinases. Mol Microbiol. Jun. 1990;4(6):991-7. doi: 10.1111/j.1365-2958.1990.tb00671.x.

Ikediobi et al., Mutation analysis of 24 known cancer genes in the NCI-60 cell line set. Mol Cancer Ther. Nov. 2006;5(11):2606-12. Epub Nov. 6, 2006.

Imanishi et al., Detection of N6-methyladenosine based on the methyl-sensitivity of MazF RNA endonuclease. Chem Commun (Camb). Nov. 30, 2017;53(96):12930-12933. doi: 10.1039/c7cc07699a.

Imburgio et al., Studies of promoter recognition and start site selection by T7 RNA polymerase using a comprehensive collection of promoter variants. Biochemistry. Aug. 29, 2000;39(34):10419-30.

Ingram, A specific chemical difference between the globins of normal human and sickle-cell anaemia haemoglobin. Nature. Oct. 13, 1956;178(4537):792-4. doi: 10.1038/178792a0.

Irion et al., Identification and targeting of the ROSA26 locus in human embryonic stem cells. Nat Biotechnol. Dec. 2007;25(12):1477-82. doi: 10.1038/nbt1362. Epub Nov. 25, 2007.

Irrthum et al., Congenital hereditary lymphedema caused by a mutation that inactivates VEGFR3 tyrosine kinase. Am J Hum Genet. Aug. 2000;67(2):295-301. Epub Jun. 9, 2000.

Isaacs et al., Engineered riboregulators enable post-transcriptional control of gene expression. Nat Biotechnol. Jul. 2004;22(7):841-7. doi: 10.1038/nbt986. Epub Jun. 20, 2004.

Ishino et al., Nucleotide sequence of the iap gene, responsible for alkaline phosphatase isozyme conversion in *Escherichia coli*, and identification of the gene product. J Bacteriol. Dec. 1987; 169(12):5429-33.

(56) References Cited

OTHER PUBLICATIONS

Ishizuka et al., Loss of ADAR1 in tumours overcomes resistance to immune checkpoint blockade. Nature. Jan. 2019;565(7737):43-48. doi: 10.1038/s41586-018-0768-9. Epub Dec. 17, 2018.
Iwai et al., Circular beta-lactamase: stability enhancement by cyclizing the backbone. FEBS Lett. Oct. 8, 1999;459(2):166-72. doi: 10.1016/s0014-5793(99)01220-x.
Iwai et al., Highly efficient protein trans-splicing by a naturally split DnaE intein from Nostoc punctiforme. FEBS Lett. Mar. 20, 2006;580(7):1853-8. doi: 10.1016/j.febslet.2006.02.045. Epub Feb. 24, 2006.
Jaffrey et al., Emerging links between m6A and misregulated mRNA methylation in cancer. Genome Med. Jan. 12, 2017;9(1):2. doi: 10.1186/s13073-016-0395-8.
Jamieson et al., Drug discovery with engineered zinc-finger proteins. Nat Rev Drug Discov. May 2003;2(5):361-8.
Jansen et al., Backbone and nucleobase contacts to glucosamine-6-phosphate in the glmS ribozyme. Nat Struct Mol Biol. Jun. 2006;13(6):517-23. Epub May 14, 2006.
Jansen et al., Identification of genes that are associated with DNA repeats in prokaryotes. Mol Microbiol. Mar. 2002;43(6):1565-75.
Jardine et al., HIV-1 Vaccines. Priming a broadly neutralizing antibody response to HIV-1 using a germline-targeting immunogen. Science. Jul. 10, 2015;349(6244):156-61. doi: 10.1126/science.aac5894. Epub Jun. 18, 2015.
Jasin et al., Repair of strand breaks by homologous recombination. Cold Spring Harb Perspect Biol. Nov. 1, 2013;5(11):a012740. doi: 10.1101/cshperspect.a012740.
Jeggo, DNA breakage and repair. Adv Genet. 1998;38:185-218. doi: 10.1016/s0065-2660(08)60144-3.
Jemielity et al., Novel “anti-reverse” cap analogs with superior translational properties. RNA. Sep. 2003;9(9):1108-22. doi: 10.1261/rna.5430403.
Jenkins et al., Comparison of a preQ1 riboswitch aptamer in metabolite-bound and free states with implications for gene regulation. J Biol Chem. Jul. 15, 2011;286(28):24626-37. doi: 10.1074/jbc.M111.230375. Epub May 18, 2011.
Jeong et al., Measurement of deoxyinosine adduct: Can it be a reliable tool to assess oxidative or nitrosative DNA damage? Toxicol Lett. Oct. 17, 2012;214(2):226-33. doi: 10.1016/j.toxlet.2012.08.013. Epub Aug. 23, 2012.
Jia et al., The MLH1 ATPase domain is needed for suppressing aberrant formation of interstitial telomeric sequences. DNA Repair (Amst). May 2018;65:20-25. doi: 10.1016/j.dnarep.2018.03.002. Epub Mar. 7, 2018.
Jiang et al., Chemical modifications of adenine base editor mRNA and guide RNA expand its application scope. Nat Commun. Apr. 24, 2020;11(1):1979. doi: 10.1038/s41467-020-15892-8.
Jiang et al., CRISPR-Cas9 Structures and Mechanisms. Annu Rev Biophys. May 22, 2017;46:505-529. doi: 10.1146/annurev-biophys-062215-010822. Epub Mar. 30, 2017.
Jiang et al., Prime editing efficiently generates W542L and S621I double mutations in two ALS genes of maize. bioRxiv preprint. Jul. 6, 2020. Retrieved from www.biorxiv.org. doi: 10.1101/2020.07.06.188896. 15 pages.
Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.
Jiang et al., Structural Biology. A Cas9-guide RNA Complex Preorganized for Target DNA Recognition. Science. Jun. 26, 2015;348(6242):1477-81. doi: 10.1126/science.aab1452.
Jiang et al., Structures of a CRISPR-Cas9 R-loop complex primed for DNA cleavage. Science. Feb. 19, 2016;351(6275):867-71. doi: 10.1126/science.aad8282. Epub Jan. 14, 2016.
Jin et al., Cytosine, but not adenine, base editors induce genome-wide off-target mutations in rice. Science. Apr. 19, 2019;364(6437):292-295. doi: 10.1126/science.aaw7166. Epub Feb. 28, 2019.
Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.
Jinek et al., RNA-programmed genome editing in human cells. Elife. Jan. 29, 2013;2:e00471. doi: 10.7554/eLife.00471.
Jinek et al., Structures of Cas9 endonucleases reveal RNA-mediated conformational activation. Science. Mar. 14, 2014;343(6176):1247997. doi: 10.1126/science.1247997. Epub Feb. 6, 2014.
Jiricny, The multifaceted mismatch-repair system. Nat Rev Mol Cell Biol. May 2006;7(5):335-46. doi: 10.1038/nrm1907.
Johann et al., GLVR1, a receptor for gibbon ape leukemia virus, is homologous to a phosphate permease of Neurospora crassa and is expressed at high levels in the brain and thymus. J Virol. Mar. 1992;66(3):1635-40. doi: 10.1128/JVI.66.3.1635-1640.1992.
Johansson et al., RNA Recognition by the MS2 Phage Coat Protein. Seminars in Virology. 1997;8(3):176-85. https://doi.org/10.1006/smvy.1997.0120.
Johansson et al., Selenocysteine in proteins-properties and biotechnological use. Biochim Biophys Acta. Oct. 30, 2005;1726(1):1-13. Epub Jun. 1, 2005.
Johns et al., The promise and peril of continuous in vitro evolution. J Mol Evol. Aug. 2005;61(2):253-63. Epub Jun. 27, 2005.
Johnson et al., Trans insertion-splicing: ribozyme-catalyzed insertion of targeted sequences into RNAs. Biochemistry. Aug. 9, 2005;44(31):10702-10. doi: 10.1021/bi0504815.
Joho et al., Identification of a region of the bacteriophage T3 and T7 RNA polymerases that determines promoter specificity. J Mol Biol. Sep. 5, 1990;215(1):31-9.
Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al., TALENs: a widely applicable technology for targeted genome editing. Nat Rev Mol Cell Biol. Jan. 2013;14(1):49-55. doi: 10.1038/nrm3486. Epub Nov. 21, 2012.
Joyce et al., Amplification, mutation and selection of catalytic RNA. Gene. Oct. 15, 1989;82(1):83-7. doi: 10.1016/0378-1119(89)90033-4.
Jusiak et al., Comparison of Integrases Identifies Bxb1-GA Mutant as the Most Efficient Site-Specific Integrase System in Mammalian Cells. ACS Synth Biol. Jan. 18, 2019;8(1):16-24. doi: 10.1021/acssynbio.8b00089. Epub Jan. 9, 2019.
Jyothy et al., Translocation Down syndrome. Indian J Med Sci. Mar. 2002;56(3):122-6.
Kacian et al., Purification of the DNA polymerase of avian myeloblastosis virus. Biochim Biophys Acta. Sep. 24, 1971;246(3):365-83. doi: 10.1016/0005-2787(71)90773-8.
Kaczmarczyk et al., Manipulating the Prion Protein Gene Sequence and Expression Levels with CRISPR/Cas9. PLoS One. Apr. 29, 2016;11(4):e0154604. doi: 10.1371/journal.pone.0154604.
Kadoch et al., Reversible disruption of mSWI/SNF (BAF) complexes by the SS18-SSX oncogenic fusion in synovial sarcoma. Cell. Mar. 28, 2013;153(1):71-85. doi: 10.1016/j.cell.2013.02.036.
Kahmann et al., G inversion in bacteriophage Mu DNA is stimulated by a site within the invertase gene and a host factor. Cell. Jul. 1985;41(3):771-80. doi: 10.1016/s0092-8674(85)80058-1.
Kaiser et al., Gene therapy. Putting the fingers on gene repair. Science. Dec. 23, 2005;310(5756):1894-6.
Kakiyama et al., A peptide release system using a photo-cleavable linker in a cell array format for cell-toxicity analysis. Polymer J. Feb. 27, 2013;45:535-9.
Kalyaanamoorthy et al., ModelFinder: fast model selection for accurate phylogenetic estimates. Nat Methods. Jun. 2017; 14(6):587-589. doi: 10.1038/nmeth.4285. Epub May 8, 2017.
Kan et al., Mechanisms of precise genome editing using oligonucleotide donors. Genome Res. Jul. 2017;27(7):1099-1111. doi: 10.1101/gr.214775.116. Epub Mar. 29, 2017.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Kang et al., Structural Insights into riboswitch control of the biosynthesis of queuosine, a modified nucleotide found in the anticodon of tRNA. Mol Cell. Mar. 27, 2009;33(6):784-90. doi: 10.1016/j.molcel.2009.02.019. Epub Mar. 12, 2009.

(56) References Cited

OTHER PUBLICATIONS

Kang et al., Precision genome engineering through adenine base editing in plants. Nat Plants. Jul. 2018;4(7):427-431. doi: 10.1038/s41477-018-0178-x. Epub Jun. 4, 2018. Erratum in: Nat Plants. Sep. 2018;4(9):730.
Kao et al., Cleavage specificity of *Saccharomyces cerevisiae* flap endonuclease 1 suggests a double-flap structure as the cellular substrate. J Biol Chem. Apr. 26, 2002;277(17):14379-89. doi: 10.1074/jbc.M110662200. Epub Feb. 1, 2002.
Kappel et al., Regulating gene expression in transgenic animals. Curr Opin Biotechnol. Oct. 1992;3(5):548-53.
Karimova et al., Discovery of Nigri/nox and Panto/pox site-specific recombinase systems facilitates advanced genome engineering. Sci Rep. Jul. 22, 2016;6:30130. doi: 10.1038/srep30130.
Karimova et al., Vika/vox, a novel efficient and specific Cre/loxP-like site-specific recombination system. Nucleic Acids Res. Jan. 2013;41(2):e37. doi: 10.1093/nar/gks1037. Epub Nov. 9, 2012.
Karpenshif et al., From yeast to mammals: recent advances in genetic control of homologous recombination. DNA Repair (Amst). Oct. 1, 2012;11(10):781-8. doi: 10.1016/j.dnarep.2012.07.001. Epub Aug. 11, 2012. Review.
Karpinsky et al., Directed evolution of a recombinase that excises the provirus of most HIV-1 primary isolates with high specificity. Nat Biotechnol. Apr. 2016;34(4):401-9. doi: 10.1038/nbt.3467. Epub Feb. 22, 2016.
Katafuchi et al., DNA polymerases involved in the incorporation of oxidized nucleotides into DNA: their efficiency and template base preference. Mutat Res. Nov. 28, 2010;703(1):24-31. doi: 10.1016/j.mrgentox.2010.06.004. Epub Jun. 11, 2010.
Kato et al., Improved purification and enzymatic properties of three forms of reverse transcriptase from avian myeloblastosis virus. J Virol Methods. Dec. 1984;9(4):325-39. doi: 10.1016/0166-0934(84)90058-2.
Katoh et al., MAFFT multiple sequence alignment software version 7: improvements in performance and usability. Mol Biol Evol. Apr. 2013;30(4):772-80. doi: 10.1093/molbev/mst010. Epub Jan. 16, 2013.
Kaufman et al., Translational efficiency of polycistronic mRNAs and their utilization to express heterologous genes in mammalian cells. EMBO J. Jan. 1987;6(1):187-93.
Kavli et al., Excision of cytosine and thymine from DNA by mutants of human uracil-DNA glycosylase. EMBO J. Jul. 1, 1996;15(13):3442-7.
Kawarasaki et al., Enhanced crossover SCRATCHY: construction and high-throughput screening of a combinatorial library containing multiple non-homologous crossovers. Nucleic Acids Res. Nov. 1, 2003;31(21):e126.
Kay et al., Viral vectors for gene therapy: the art of turning infectious agents into vehicles of therapeutics. Nat Med. Jan. 2001;7(1):33-40.
Kaya et al., A bacterial Argonaute with noncanonical guide RNA specificity. Proc. Natl. Acad. Sci. USA Apr. 2016;113(15):4057-62.
Keijzers et al., Human exonuclease 1 (EXO1) activity characterization and its function on flap structures. Biosci Rep. Apr. 25, 2015;35(3):e00206. doi: 10.1042/BSR20150058.
Kellendonk et al., Regulation of Cre recombinase activity by the synthetic steroid RU 486. Nucleic Acids Res. Apr. 15, 1996;24(8):1404-11.
Kelman, PCNA: structure, functions and interactions. Oncogene. Feb. 13, 1997;14(6):629-40. doi: 10.1038/sj.onc.1200886.
Keravala et al., A diversity of serine phage integrases mediate site-specific recombination in mammalian cells. Mol Genet Genomics. Aug. 2006;276(2):135-46. doi: 10.1007/s00438-006-0129-5. Epub May 13, 2006.
Kessel et al., Murine developmental control genes. Science. Jul. 27, 1990;249(4967):374-9. doi: 10.1126/science.1974085.
Kessler et al., Gene delivery to skeletal muscle results in sustained expression and systemic delivery of a therapeutic protein. Proc Natl Acad Sci U S A. Nov. 26, 1996;93(24):14082-7. doi: 10.1073/pnas.93.24.14082.
Ketha et al., Application of bioinformatics-coupled experimental analysis reveals a new transport-competent nuclear localization signal in the nucleoprotein of Influenza A virus strain. BMC Cell Biol. Apr. 28, 2008; 9:22. https://doi.org/10.1186/1471-2121-9-22.
Kiga et al., An engineered *Escherichia coli* tyrosyl-tRNA synthetase for site-specific incorporation of an unnatural amino acid into proteins in eukaryotic translation and its application in a wheat germ cell-free system. Proc Natl Acad Sci U S A. Jul. 23, 2002;99(15):9715-20. Epub Jul. 3, 2002.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kilcher et al., Brochothrix thermosphacta bacteriophages feature heterogeneous and highly mosaic genomes and utilize unique prophage insertion sites. J Bacteriol. Oct. 2010;192(20):5441-53. doi: 10.1128/JB.00709-10. Epub Aug. 13, 2010.
Kim et al., DJ-1, a novel regulator of the tumor suppressor PTEN. Cancer Cell. 2005;7(3):263-273.
Kim et al., Genome-wide target specificity of CRISPR RNA-guided adenine base editors. Nat Biotechnol. Apr. 2019;37(4):430-435. doi: 10.1038/s41587-019-0050-1. Epub Mar. 4, 2019.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., An anionic human protein mediates cationic liposome delivery of genome editing proteins into mammalian cells. Nat Commun. Jul. 2, 2019;10(1):2905. doi: 10.1038/s41467-019-10828-3.
Kim et al., Evaluating and Enhancing Target Specificity of Gene-Editing Nucleases and Deaminases. Annu Rev Biochem. Jun. 20, 2019;88:191-220. doi: 10.1146/annurev-biochem-013118-111730. Epub Mar. 18, 2019.
Kim et al., Genome-wide target specificities of CRISPR RNA-guided programmable deaminases. Nat Biotechnol. May 2017;35(5):475-480. doi: 10.1038/nbt.3852. Epub Apr. 10, 2017.
Kim et al., High cleavage efficiency of a 2A peptide derived from porcine teschovirus-1 in human cell lines, zebrafish and mice. PLoS One. 2011;6(4):e18556. doi: 10.1371/journal.pone.0018556. Epub Apr. 29, 2011.
Kim et al., High-throughput analysis of the activities of xCas9, SpCas9-NG and SpCas9 at matched and mismatched target sequences in human cells. Nat Biomed Eng. Jan. 2020;4(1):111-124. doi: 10.1038/s41551-019-0505-1. Epub Jan. 14, 2020.
Kim et al., Highly efficient RNA-guided base editing in mouse embryos. Nat Biotechnol. May 2017;35(5):435-437. doi: 10.1038/nbt.3816. Epub Feb. 27, 2017.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., In vivo genome editing with a small Cas9 orthologue derived from Campylobacter jejuni. Nat Commun. Feb. 21, 2017;8:14500. doi: 10.1038/ncomms14500. PMID: 28220790; PMCID: PMC5473640.
Kim et al., In vivo high-throughput profiling of CRISPR-Cpf1 activity. Nat Methods. Feb. 2017;14(2):153-159. doi: 10.1038/nmeth.4104. Epub Dec. 19, 2016.
Kim et al., Increasing the genome-targeting scope and precision of base editing with engineered Cas9-cytidine deaminase fusions. Nat Biotechnol. Apr. 2017;35(4):371-376. doi: 10.1038/nbt.3803. Epub Feb. 13, 2017.
Kim et al., Mycobacteriophage Bxb1 integrates into the *Mycobacterium smegmatis* groEL1 gene. Mol Microbiol. Oct. 2003;50(2):463-73. doi: 10.1046/j.1365-2958.2003.03723.x.
Kim et al., Predicting the efficiency of prime editing guide RNAs in human cells. Nat Biotechnol. Feb. 2021;39(2):198-206. doi: 10.1038/s41587-020-0677-y. Epub Sep. 21, 2020.
Kim et al., RAD51 mutants cause replication defects and chromosomal instability. Mol Cell Biol. Sep. 2012;32(18):3663-80. doi: 10.1128/MCB.00406-12. Epub Jul. 9, 2012.
Kim et al., Rescue of high-specificity Cas9 variants using sgRNAs with matched 5' nucleotides. Genome Biol. Nov. 15, 2017;18(1):218. doi: 10.1186/s13059-017-1355-3.

(56) References Cited

OTHER PUBLICATIONS

Kim et al., Structural and kinetic characterization of *Escherichia coli* TadA, the wobble-specific tRNA deaminase. Biochemistry. May 23, 2006;45(20):6407-16. doi: 10.1021/bi0522394. PMID: 16700551.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009; 19(7):1279-88. doi: 10.1101/gr.089417.108. Epub May 21, 2009.
Kim et al., The role of apolipoprotein E in Alzheimer's disease. Neuron. Aug. 13, 2009;63(3):287-303. doi: 10.1016/j.neuron.2009.06.026.
Kim et al., Transcriptional repression by zinc finger peptides. Exploring the potential for applications in gene therapy. J Biol Chem. Nov. 21, 1997;272(47):29795-800.
King et al., No gain, no pain: NaV1.7 as an analgesic target. ACS Chem Neurosci. Sep. 17, 2014;5(9):749-51. doi: 10.1021/cn500171p. Epub Aug. 11, 2014.
Kitamura et al., Uracil DNA glycosylase counteracts APOBEC3G-induced hypermutation of hepatitis B viral genomes: excision repair of covalently closed circular DNA. PLoS Pathog. 2013;9(5):e1003361. doi: 10.1371/journal.ppat.1003361. Epub May 16, 2013.
Klapacz et al., Frameshift mutagenesis and microsatellite instability induced by human alkyladenine DNA glycosylase. Mol Cell. Mar. 26, 2010;37(6):843-53. doi: 10.1016/j.molcel.2010.01.038.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Klein et al., Cocrystal structure of a class I preQ1 riboswitch reveals a pseudoknot recognizing an essential hypermodified nucleobase. Nat Struct Mol Biol. Mar. 2009;16(3):343-4. doi: 10.1038/nsmb.1563.Epub Feb. 22, 2009.
Kleiner et al., In vitro selection of a DNA-templated small-molecule library reveals a class of macrocyclic kinase inhibitors. J Am Chem Soc. Aug. 25, 2010;132(33):11779-91. doi: 10.1021/ja104903x.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015.
Kleinstiver et al., Engineered CRISPR-Cas9 nucleases with altered PAM specificities. Nature. Jul. 23, 2015;523(7561):481-5 and Supplementary Materials. doi: 10.1038/nature14592. Epub Jun. 22, 2015. 27 pages.
Kleinstiver et al., Engineered CRISPR-Cas9 nucleases with altered PAM specificities. Nature. Jul. 23, 2015;523(7561):481-5. doi: 10.1038/nature14592. Epub Jun. 22, 2015.
Kleinstiver et al., High-fidelity CRISPR-Cas9 nucleases with no detectable genome-wide off-target effects. Nature. Jan. 28, 2016;529(7587):490-5. doi: 10.1038/nature16526. Epub Jan. 6, 2016.
Kleinstiver et al., Monomeric site-specific nucleases for genome editing. Proc Natl Acad Sci U S A. May 22, 2012;109(21):8061-6. doi: 10.1073/pnas.1117984109. Epub May 7, 2012.
Klement et al., Discrimination between bacteriophage T3 and T7 promoters by the T3 and T7 Rna polymerases depends primarily upon a three base-pair region located 10 to 12 base-pairs upstream from the start site. J Mol Biol. Sep. 5, 1990;215(1):21-9.
Klippel et al., Isolation and characterization of unusual gin mutants. EMBO J. Dec. 1, 1988;7(12):3983-9.
Klippel et al., The DNA invertase Gin of phage Mu: formation of a covalent complex with DNA via a phosphoserine at amino acid position 9. EMBO J. Apr. 1988;7(4):1229-37.
Klompe et al., Transposon-encoded CRISPR-Cas systems direct RNA-guided DNA integration. Nature. Jul. 2019;571(7764):219-225. doi: 10.1038/s41586-019-1323-z. Epub Jun. 12, 2019.
Kluesner et al., CRISPR-Cas9 cytidine and adenosine base editing of splice-sites mediates highly-efficient disruption of proteins in primary and immortalized cells. Nat Commun. Apr. 23, 2021;12(1):2437. doi: 10.1038/s41467-021-22009-2.
Knott et al., Guide-bound structures of an RNA-targeting A-cleaving CRISPR-Cas13a enzyme. Nat Struct Mol Biol. Oct. 2017;24(10):825-833. doi: 10.1038/nsmb.3466. Epub Sep. 11, 2017.
Koblan et al., In vivo base editing rescues Hutchinson-Gilford progeria syndrome in mice. Nature. Jan. 2021;589(7843):608-614. doi: 10.1038/s41586-020-03086-7. Epub Jan. 6, 2021.
Koblan et al., Efficient CoG-to-GoC base editors developed using CRISPRi screens, target-library analysis, and machine learning. Nature Biotechnol. Jun. 28, 2021. https://doi.org/10.1038/s41587-021-00938-z.
Koblan et al., Improving cytidine and adenine base editors by expression optimization and ancestral reconstruction. Nat Biotechnol. Oct. 2018;36(9):843-846. doi: 10.1038/nbt.4172. Epub May 29, 2018.
Kobori et al., Deep Sequencing Analysis of Aptazyme Variants Based on a Pistol Ribozyme. ACS Synth Biol. Jul. 21, 2017;6(7):1283-1288. doi: 10.1021/acssynbio.7b00057. Epub Apr. 14, 2017.
Kohli et al., A portable hot spot recognition loop transfers sequence preferences from APOBEC family members to activation-induced cytidine deaminase. J Biol Chem. Aug. 21, 2009;284(34):22898-904. doi: 10.1074/jbc.M109.025536. Epub Jun. 26, 2009.
Kohli et al., Local sequence targeting in the AID/APOBEC family differentially impacts retroviral restriction and antibody diversification. J Biol Chem. Dec. 24, 2010;285(52):40956-64. doi: 10.1074/jbc.M110.177402. Epub Oct. 6, 2010.
Koike-Yusa et al., Genome-wide recessive genetic screening in mammalian cells with a lentiviral CRISPR-guide RNA library. Nat Biotechnol. Mar. 2014;32(3):267-73. doi: 10.1038/nbt.2800. Epub Dec. 23, 2013.
Kolot et al., Site promiscuity of coliphage HK022 integrase as a tool for gene therapy. Gene Ther. Jul. 2015;22(7):521-7. doi: 10.1038/gt.2015.9. Epub Mar. 12, 2015.
Kolot et al., Site-specific recombination in mammalian cells expressing the Int recombinase of bacteriophage HK022. Mol Biol Rep. Aug. 1999;26(3):207-13. doi: 10.1023/a:1007096701720.
Komor et al., CRISPR-Based Technologies for the Manipulation of Eukaryotic Genomes. Cell. Jan. 12, 2017;168(1-2):20-36. doi: 10.1016/j.cell.2016.10.044.
Komor et al., Improved base excision repair inhibition and bacteriophage Mu Gam protein yields C:G-to-T:A base editors with higher efficiency and product purity. Sci Adv. Aug. 30, 2017;3(8):eaao4774. doi: 10.1126/sciadv.aao4774. eCollection Aug. 2017.
Komor et al., Programmable editing of a target base in genomic DNA without double-stranded DNA cleavage. Nature. Apr. 20, 2016;533(7603):420-4. doi: 10.1038/nature17946.
Komor, Editing the Genome Without Double-Stranded DNA Breaks. ACS Chem Biol. Feb. 16, 2018;13(2):383-388. doi: 10.1021/acschembio.7b00710. Epub Oct. 9, 2017.
Konermann et al., Genome-scale transcriptional activation by an engineered CRISPR-Cas9 complex. Nature. Jan. 29, 2015;517(7536):583-8. doi: 10.1038/nature14136. Epub Dec. 10, 2014.
Koonin et al., Diversity, classification and evolution of CRISPR-Cas systems. Curr Opin Microbiol. 2017;37:67?78. doi:10.1016/j.mib.2017.05.008.
Kosicki et al., Repair of double-strand breaks induced by CRISPR-Cas9 leads to large deletions and complex rearrangements. Nat Biotechnol. Sep. 2018;36(8):765-771. doi: 10.1038/nbt.4192. Epub Jul. 16, 2018.
Kotewicz et al., Cloning and overexpression of Moloney murine leukemia virus reverse transcriptase in *Escherichia coli*. Gene. 1985;35(3):249-58. doi: 10.1016/0378-1119(85)90003-4.
Kotewicz et al., Isolation of cloned Moloney murine leukemia virus reverse transcriptase lacking ribonuclease H activity. Nucleic Acids Res. Jan. 11, 1988;16(1):265-77. doi: 10.1093/nar/16.1.265.
Kotin, Prospects for the use of adeno-associated virus as a vector for human gene therapy. Hum Gene Ther. Jul. 1994;5(7):793-801. doi: 10.1089/hum.1994.5.7-793.

(56) References Cited

OTHER PUBLICATIONS

Kouzminova et al., Patterns of chromosomal fragmentation due to uracil-DNA incorporation reveal a novel mechanism of replication-dependent double-stranded breaks. Mol Microbiol. Apr. 2008;68(1):202-15. doi: 10.1111/j.1365-2958.2008.06149.x.
Kowal et al., Exploiting unassigned codons in Micrococcus luteus for tRNA-based amino acid mutagenesis. Nucleic Acids Res. Nov. 15, 1997;25(22):4685-9.
Kowalski et al., Delivering the Messenger: Advances in Technologies for Therapeutic mRNA Delivery. Mol Ther. Apr. 10, 2019;27(4):710-728. doi: 10.1016/j.ymthe.2019.02.012. Epub Feb. 19, 2019.
Kozak, An analysis of 5'-noncoding sequences from 699 vertebrate messenger RNAs. Nucleic Acids Res. Oct. 26, 1987;15(20):8125-48. doi: 10.1093/nar/15.20.8125.
Kraft et al., Deletions, Inversions, Duplications: Engineering of Structural Variants using CRISPR/Cas in Mice. Cell Rep. Feb. 10, 2015;10(5):833-839. doi: 10.1016/j.celrep.2015.01.016. Epub Feb. 7, 2015.
Kremer et al., Adenovirus and adeno-associated virus mediated gene transfer. Br Med Bull. Jan. 1995;51(1):31-44. doi: 10.1093/oxfordjournals.bmb.a072951.
Krokan et al, Uracil in DNA—occurrence, consequences and repair. Oncogene. Dec. 16, 2002;21(58):8935-48. doi: 10.1038/sj.onc.1205996.
Krokan et al., Base excision repair. Cold Spring Harb Perspect Biol. Apr. 1, 2013;5(4):a012583. doi: 10.1101/cshperspect.a012583.
Krzywkowski et al., Limited reverse transcriptase activity of phi29 DNA polymerase. Nucleic Acids Res. Apr. 20, 2018;46(7):3625-3632. doi: 10.1093/nar/gky190.
Kumar et al., Gene therapy for chronic neuropathic pain: how does it work and where do we stand today? Pain Med. May 2011;12(5):808-22. doi: 10.1111/j.1526-4637.2011.01120.x.
Kumar et al., Structural and functional consequences of the mutation of a conserved arginine residue in alphaA and alphaB crystallins. J Biol Chem. Aug. 2, 19990;274(34):24137-41.
Kundu et al., Leucine to proline substitution by SNP at position 197 in Caspase-9 gene expression leads to neuroblastoma: a bioinformatics analysis. 3 Biotech. 2013; 3:225-34.
Kunkel et al., Eukaryotic Mismatch Repair in Relation to DNA Replication. Annu Rev Genet. 2015;49:291-313. doi: 10.1146/annurev-genet-112414-054722.
Kunz et al., DNA Repair in mammalian cells: Mismatched repair: variations on a theme. Cell Mol Life Sci. Mar. 2009;66(6):1021-38. doi: 10.1007/s00018-009-8739-9.
Kurjan et al., Structure of a yeast pheromone gene (MF alpha): a putative alpha-factor precursor contains four tandem copies of mature alpha-factor. Cell. Oct. 1982;30(3):933-43. doi: 10.1016/0092-8674(82)90298-7.
Kury et al., De Novo Disruption of the Proteasome Regulatory Subunit PSMD12 Causes a Syndromic Neurodevelopmental Disorder. Am J Hum Genet. Feb. 2, 2017;100(2):352-363. doi: 10.1016/j.ajhg.2017.01.003. Epub Jan. 26, 2017.
Kuscu et al., CRISPR-Cas9-AID base editor is a powerful gain-of-function screening tool. Nat Methods. Nov. 29, 2016;13(12):983-984. doi: 10.1038/nmeth.4076.
Kuscu et al., CRISPR-STOP: gene silencing through base-editing-induced nonsense mutations. Nat Methods. Jul. 2017; 14(7):710-712. doi: 10.1038/nmeth.4327. Epub Jun. 5, 2017.
Kuscu et al., Genome-wide analysis reveals characteristics of off-target sites bound by the Cas9 endonuclease. Nat Biotechnol. Jul. 2014;32(7):677-83. doi: 10.1038/nbt.2916. Epub May 18, 2014.
Kwart et al., Precise and efficient scarless genome editing in stem cells using CORRECT. Nat Protoc. Feb. 2017;12(2):329-354. doi: 10.1038/nprot.2016.171. Epub Jan. 19, 2017.
Kweon et al., Fusion guide RNAs for orthogonal gene manipulation with Cas9 and Cpf1. Nat Commun. Nov. 23, 2017;8(1):1723. doi: 10.1038/s41467-017-01650-w. Erratum in: Nat Commun. Jan. 16, 2018;9(1):303.
Kwon et al., Chemical basis of glycine riboswitch cooperativity. RNA. Jan. 2008;14(1):25-34. Epub Nov. 27, 2007.
Köhrer et al., A possible approach to site-specific insertion of two different unnatural amino acids into proteins in mammalian cells via nonsense suppression. Chem Biol. Nov. 2003;10(11):1095-102.
Köhrer et al., Complete set of orthogonal 21st aminoacyl-tRNA synthetase-amber, ochre and opal suppressor tRNA pairs: concomitant suppression of three different termination codons in an mRNA in mammalian cells. Nucleic Acids Res. Dec. 1, 2004;32(21):6200-11. Print 2004.
Kügler et al., Human synapsin 1 gene promoter confers highly neuron-specific long-term transgene expression from an adenoviral vector in the adult rat brain depending on the transduced area. Gene Ther. Feb. 2003; 10(4):337-47. doi: 10.1038/sj.gt.3301905.
Lada et al., Mutator effects and mutation signatures of editing deaminases produced in bacteria and yeast. Biochemistry (Mosc). Jan. 2011;76(1):131-46.
Lakich et al., Inversions disrupting the factor VIII gene are a common cause of severe haemophilia A. Nat Genet. Nov. 1993;5(3):236-41. doi: 10.1038/ng1193-236.
Lancaster et al., Limited trafficking of a neurotropic virus through inefficient retrograde axonal transport and the type I interferon response. PLoS Pathog. Mar. 5, 2010;6(3):e1000791. doi: 10.1371/journal.ppat.1000791.
Landrum et al., ClinVar: public archive of interpretations of clinically relevant variants. Nucleic Acids Res. Jan. 4, 2016;44(D1):D862-8. doi: 10.1093/nar/gkv1222. Epub Nov. 17, 2015.
Landrum et al., ClinVar: public archive of relationships among sequence variation and human phenotype. Nucleic Acids Res. Jan. 2014;42(Database issue):D980-5. doi: 10.1093/nar/gkt1113. Epub Nov. 14, 2013.
Langer et al., Chemical and Physical Structure of Polymers as Carriers for Controlled Release of Bioactive Agents: A Review. Journal of Macromolecular Science, 2006;23(1):61-126. DOI: 10.1080/07366578308079439.
Langer et al., New methods of drug delivery. Science. Sep. 28, 1990;249(4976):1527-33.
Lapinaite et al., DNA capture by a CRISPR-Cas9-guided adenine base editor. Science. Jul. 31, 2020;369(6503):566-571. doi: 10.1126/science.abb1390.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lau et al., Molecular basis for discriminating between normal and damaged bases by the human alkyladenine glycosylase, AAG. Proc Natl Acad Sci U S A. Dec. 5, 2000;97(25):13573-8.
Lauer et al., Construction, characterization, and use of two Listeria monocytogenes site-specific phage integration vectors. J Bacteriol. Aug. 2002;184(15):4177-86. doi: 10.1128/jb.184.15.4177-4186.2002.
Lavergne et al., Defects in type IIA von Willebrand disease: a cysteine 509 to arginine substitution in the mature von Willebrand factor disrupts a disulphide loop involved in the interaction with platelet glycoprotein Ib-IX. Br J Haematol. Sep. 1992;82(1):66-72.
Lawrence et al., Supercharging proteins can impart unusual resilience. J Am Chem Soc. Aug. 22, 2007;129(33):10110-2. Epub Aug. 1, 2007.
Lawyer et al., High-level expression, purification, and enzymatic characterization of full-length Thermus aquaticus DNA polymerase and a truncated form deficient in 5' to 3' exonuclease activity. PCR Methods Appl. May 1993;2(4):275-87. doi: 10.1101/gr.2.4.275.
Lazar et al., Transforming growth factor alpha: mutation of aspartic acid 47 and leucine 48 results in different biological activities. Mol Cell Biol. Mar. 1988;8(3):1247-52.
Lazarevic et al., Nucleotide sequence of the Bacillus subtilis temperate bacteriophage SPbetac2. Microbiology (Reading). May 1999;145 ( Pt 5):1055-1067. doi: 10.1099/13500872-145-5-1055.
Le Grice et al., Purification and characterization of recombinant equine infectious anemia virus reverse transcriptase. J Virol. Dec. 1991;65(12):7004-7. doi: 10.1128/JVI.65.12.7004-7007.1991.
Leaver-Fay et al., ROSETTA3: an object-oriented software suite for the simulation and design of macromolecules. Methods Enzymol. 2011;487:545-74. doi: 10.1016/B978-0-12-381270-4.00019-6.

(56) References Cited

OTHER PUBLICATIONS

Leconte et al., A population-based experimental model for protein evolution: effects of mutation rate and selection stringency on evolutionary outcomes. Biochemistry. Feb. 26, 2013;52(8):1490-9. doi: 10.1021/bi3016185. Epub Feb. 14, 2013.

Ledford, Gene-editing hack yields pinpoint precision. Nature, Apr. 20, 2016. http://www.nature.com/news/gene-editing-hack-yields-pinpoint-precision-1.19773.

Lee et al., A chimeric thyroid hormone receptor constitutively bound to DNA requires retinoid X receptor for hormone-dependent transcriptional activation in yeast. Mol Endocrinol. Sep. 1994;8(9):1245-52.

Lee et al., A monoclonal antibody that targets a NaV1.7 channel voltage sensor for pain and itch relief. Cell. Jun. 5, 2014;157(6):1393-1404. doi: 10.1016/j.cell.2014.03.064. Epub May 22, 2014. Retraction in: Cell. Jun. 25, 2020;181(7):1695.

Lee et al., An allosteric self-splicing ribozyme triggered by a bacterial second messenger. Science. Aug. 13, 2010;329(5993):845-8. doi: 10.1126/science.1190713.

Lee et al., Failure to detect DNA-guided genome editing using Natronobacterium gregoryi Argonaute. Nat Biotechnol. Nov. 28, 2016;35(1):17-18. doi: 10.1038/nbt.3753.

Lee et al., Group I Intron-Based Therapeutics Through Trans-Splicing Reaction. Prog Mol Biol Transl Sci. 2018;159:79-100. doi: 10.1016/bs.pmbts.2018.07.001. Epub Aug. 9, 2018.

Lee et al., PIK3CA gene is frequently mutated in breast carcinomas and hepatocellular carcinomas. Oncogene. Feb. 17, 2005;24(8):1477-80.

Lee et al., Recognition of liposomes by cells: in vitro binding and endocytosis mediated by specific lipid headgroups and surface charge density. Biochim Biophys Acta. Jan. 31, 1992;1103(2):185-97.

Lee et al., Ribozyme Mediated gRNA Generation for In Vitro and In Vivo CRISPR/Cas9 Mutagenesis. PLoS One. Nov. 10, 2016;11(11):e0166020. doi: 10.1371/journal.pone.0166020. eCollection 2016.

Lee et al., Simultaneous targeting of linked loci in mouse embryos using base editing. Sci Rep. Feb. 7, 2019;9(1):1662. doi: 10.1038/s41598-018-33533-5.

Lee et al., Site-specific integration of mycobacteriophage L5: integration-proficient vectors for *Mycobacterium smegmatis, Mycobacterium tuberculosis*, and bacille Calmette-Guérin. Proc Natl Acad Sci U S A. Apr. 15, 1991;88(8):3111-5. doi: 10.1073/pnas.88.8.3111.

Lee et al., Synthetically modified guide RNA and donor DNA are a versatile platform for CRISPR-Cas9 engineering. Elife. May 2, 2017;6:e25312. doi: 10.7554/eLife.25312.

Lee et al., Targeted chromosomal deletions in human cells using zinc finger nucleases. Genome Res. Jan. 2010 20: 81-89; Published in Advance Dec. 1, 2009, doi:10.1101/gr.099747.109.

Lee et al., Targeting fidelity of adenine and cytosine base editors in mouse embryos. Nat Commun. Nov. 15, 2018;9(1):4804. doi: 10.1038/s41467-018-07322-7.

Lee et al., Transcriptional regulation and its misregulation in disease. Cell. Mar. 14, 2013;152(6):1237-51. doi: 10.1016/j.cell.2013.02.014.

Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.

Lei et al., Site-specificity of serine integrase demonstrated by the attB sequence preference of ?BT1 integrase. FEBS Lett. Apr. 2018;592(8):1389-1399. doi: 10.1002/1873-3468.13023. Epub Mar. 25, 2018.

Leipold et al., A de novo gain-of-function mutation in SCN11A causes loss of pain perception. Nat Genet. Nov. 2013;45(11):1399-404. doi: 10.1038/ng.2767. Epub Sep. 15, 2013.

Lemos et al., CRISPR/Cas9 cleavages in budding yeast reveal templated insertions and strand-specific insertion/deletion profiles. Proc Natl Acad Sci U S A. Feb. 27, 2018;115(9):E2040-E2047. doi: 10.1073/pnas.1716855115. Epub Feb. 13, 2018.

Lenk et al., Pathogenic mechanism of the FIG4 mutation responsible for Charcot-Marie-Tooth disease CMT4J. PLoS Genet. Jun. 2011;7(6):e1002104. doi: 10.1371/journal.pgen.1002104. Epub Jun. 2, 2011.

Levy et al., Cytosine and adenine base editing of the brain, liver, retina, heart and skeletal muscle of mice via adeno-associated viruses. Nat Biomed Eng. 2020;4(1):97-110. doi:10.1038/s41551-019-0501-5.

Levy et al., Inhibition of calcification of bioprosthetic heart valves by local controlled-release diphosphonate. Science. Apr. 12, 1985;228(4696):190-2.

Levy et al., Membrane-associated guanylate kinase dynamics reveal regional and developmental specificity of synapse stability. J Physiol. Mar. 1, 2017;595(5):1699-1709. doi: 10.1113/JP273147. Epub Jan. 18, 2017.

Lew et al., Protein splicing in vitro with a semisynthetic two-component minimal intein. J Biol Chem. Jun. 26, 1998;273(26):15887-90. doi: 10.1074/jbc.273.26.15887.

Lewis et al., A serum-resistant cytofectin for cellular delivery of antisense oligodeoxynucleotides and plasmid DNA. Proc Natl Acad Sci U S A. Apr. 16, 1996;93(8):3176-81.

Lewis et al., Building the Class 2 CRISPR-Cas Arsenal. Mol Cell 2017;65(3);377-379.

Lewis et al., Codon 129 polymorphism of the human prion protein influences the kinetics of amyloid formation. J Gen Virol. Aug. 2006;87(Pt 8):2443-9.

Lewis et al., Cytosine deamination and the precipitous decline of spontaneous mutation during Earth's history. Proc Natl Acad Sci U S A. Jul. 19, 2016;113(29):8194-9. doi: 10.1073/pnas.1607580113. Epub Jul. 5, 2016.

Lewis et al., RNA modifications and structures cooperate to guide RNA-protein interactions. Nat Rev Mol Cell Biol. Mar. 2017;18(3):202-210. doi: 10.1038/nrm.2016.163. Epub Feb. 1, 2017.

Li et al., A Radioactivity-Based Assay for Screening Human m6A-RNA Methyltransferase, METTL3-METTL14 Complex, and Demethylase ALKBH5. J Biomol Screen. Mar. 2016;21(3):290-7. doi: 10.1177/1087057115623264. Epub Dec. 23, 2015.

Li et al., Base editing with a Cpf1-cytidine deaminase fusion. Nat Biotechnol. Apr. 2018;36(4):324-327. doi: 10.1038/nbt.4102. Epub Mar. 19, 2018.

Li et al., Current approaches for engineering proteins with diverse biological properties. Adv Exp Med Biol. 2007;620:18-33.

Li et al., Disruption of splicing-regulatory elements using CRISPR/Cas9 to rescue spinal muscular atrophy in human iPSCs and mice. National Science Review. Jan. 1, 2020:92-101. DOI: 10.1093/nsr/nwz131. Retrieved from the Internet via https://academic.oup.com/nsr/article-pdf/7/1/92/33321439/nwz131.pdf. Last accessed Apr. 28, 2021.

Li et al., Fast and accurate short read alignment with Burrows-Wheeler transform. Bioinformatics. Jul. 15, 2009;25(14):1754-60. doi: 10.1093/bioinformatics/btp324. Epub May 18, 2009.

Li et al., Generation of Targeted Point Mutations in Rice by a Modified CRISPR/Cas9 System. Mol Plant. Mar. 6, 2017;10(3):526-529. doi: 10.1016/j.molp.2016.12.001. Epub Dec. 8, 2016.

Li et al., Highly efficient and precise base editing in discarded human tripronuclear embryos. Protein Cell. Aug. 19, 2017. doi: 10.1007/s13238-017-0458-7. [Epub ahead of print].

Li et al., Lagging strand DNA synthesis at the eukaryotic replication fork involves binding and stimulation of FEN-1 by proliferating cell nuclear antigen. J Biol Chem. Sep. 22, 1995;270(38):22109-12. doi: 10.1074/jbc.270.38.22109.

Li et al., Loss of post-translational modification sites in disease. Pac Symp Biocomput. 2010:337-47. doi: 10.1142/9789814295291_0036.

Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.

Li et al., Multiplex and homologous recombination-mediated genome editing in *Arabidopsis* and Nicotiana benthamiana using guide RNA and Cas9. Nat Biotechnol. Aug. 2013;31(8):688-91. doi: 10.1038/nbt.2654.

(56) References Cited

OTHER PUBLICATIONS

Li et al., Precise Modifications of Both Exogenous and Endogenous Genes in Rice by Prime Editing. Mol Plant. May 4, 2020;13(5):671-674. doi: 10.1016/j.molp.2020.03.011. Epub Mar. 25, 2020.
Li et al., Programmable Single and Multiplex Base-Editing in Bombyx mori Using RNA-Guided Cytidine Deaminases. G3 (Bethesda). May 4, 2018;8(5):1701-1709. doi: 10.1534/g3.118.200134.
Li et al., Protein trans-splicing as a means for viral vector-mediated in vivo gene therapy. Hum Gene Ther. Sep. 2008;19(9):958-64. doi: 10.1089/hum.2008.009.
Li et al., RSEM: accurate transcript quantification from RNA-Seq data with or without a reference genome. BMC Bioinformatics. Aug. 4, 2011;12:323. doi: 10.1186/1471-2105-12-323.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Li, Mechanisms and functions of DNA mismatch repair. Cell Res. Jan. 2008;18(1):85-98. doi: 10.1038/cr.2007.115.
Liang et al., Correction of ?-thalassemia mutant by base editor in human embryos. Protein Cell. Nov. 2017;8(11):811-822. doi: 10.1007/s13238-017-0475-6. Epub Sep. 23, 2017.
Liang et al., Homology-directed repair is a major double-strand break repair pathway in mammalian cells. Proc Natl Acad Sci U S A. Apr. 28, 1998;95(9):5172-7. doi: 10.1073/pnas.95.9.5172.
Liang et al., Rapid and highly efficient mammalian cell engineering via Cas9 protein transfection. Send to; J Biotechnol. Aug. 20, 2015;208:44-53. doi: 10.1016/j.jbiotec.2015.04.024.
Liao et al., One-step assembly of large CRISPR arrays enables multi-functional targeting and reveals constraints on array design. bioRxiv. May 2, 2018. doi: 10.1101/312421. 45 pages.
Lieber et al., Mechanism and regulation of human non-homologous DNA end-joining. Nat Rev Mol Cell Biol. Sep. 2003;4(9):712-20.
Liefke et al., The oxidative demethylase ALKBH3 marks hyperactive gene promoters in human cancer cells. Genome Med. Jun. 30, 2015;7(1):66. doi: 10.1186/s13073-015-0180-0.
Lienert et al., Two- and three-input TALE-based AND logic computation in embryonic stem cells. Nucleic Acids Res. Nov. 2013;41(21):9967-75. doi: 10.1093/nar/gkt758. Epub Aug. 27, 2013.
Lilley, D.M. The Varkud Satellite Ribozyme. RNA. Feb. 2004;10(2):151-8.doi: 10.1261/rna.5217104.
Lim et al., Crystal structure of the moloney murine leukemia virus RNase H domain. J Virol. Sep. 2006;80(17):8379-89. doi: 10.1128/JVI.00750-06.
Lim et al., Viral vectors for neurotrophic factor delivery: a gene therapy approach for neurodegenerative diseases of the CNS. Pharmacol Res. Jan. 2010;61(1):14-26. doi: 10.1016/j.phrs.2009.10.002. Epub Oct. 17, 2009.
Lin et al., Enhanced homology-directed human genome engineering by controlled timing of CRISPR/Cas9 delivery. Elife. Dec. 15, 2014;3:e04766. doi: 10.7554/eLife.04766.
Lin et al., High-efficiency prime editing with optimized, paired pegRNAs in plants. Nat Biotechnol. Aug. 2021;39(8):923-927. doi: 10.1038/s41587-021-00868-w. Epub Mar. 25, 2021.
Lin et al., Prime genome editing in rice and wheat. Nat Biotechnol. May 2020;38(5):582-585 and Supplemental Info. doi: 10.1038/s41587-020-0455-x. Epub Mar. 16, 2020. 8 pages.
Lin et al., Prime genome editing in rice and wheat. Nat Biotechnol. May 2020;38(5):582-585. doi: 10.1038/s41587-020-0455-x. Epub Mar. 16, 2020.
Lin et al., The human REV1 gene codes for a DNA template-dependent dCMP transferase. Nucleic Acids Res. Nov. 15, 1999;27(22):4468-75. doi: 10.1093/nar/27.22.4468.
Lindahl, T., Instability and decay of the primary structure of DNA. Nature. Apr. 22, 1993;362(6422):709-15. doi: 10.1038/362709a0.
Link et al., Engineering ligand-responsive gene-control elements: lessons learned from natural riboswitches. Gene Ther. Oct. 2009;16(10):1189-201. doi: 10.1038/gt.2009.81. Epub Jul. 9, 2009. Review.
Liu et al., C2c1-sgRNA Complex Structure Reveals RNA-Guided DNA Cleavage Mechanism. Molecular Cell Jan. 2017;65(2):310-22.
Liu et al., Split dnaE genes encoding multiple novel inteins in Trichodesmium erythraeum. J Biol Chem. Jul. 18, 2003;278(29):26315-8. doi: 10.1074/jbc.C300202200. Epub May 24, 2003.
Liu et al., A METTL3-METTL14 complex mediates mammalian nuclear RNA N6-adenosine methylation. Nat Chem Biol. Feb. 2014;10(2):93-5. doi: 10.1038/nchembio.1432. Epub Dec. 6, 2013.
Liu et al., Adding new chemistries to the genetic code. Annu Rev Biochem. 2010;79:413-44. doi: 10.1146/annurev.biochem.052308.105824.
Liu et al., Apolipoprotein E and Alzheimer disease: risk, mechanisms and therapy. Nat Rev Neurol. Feb. 2013;9(2):106-18. doi: 10.1038/nrneurol.2012.263. Epub Jan. 8, 2013.
Liu et al., Balancing AID and DNA repair during somatic hypermutation. Trends Immunol. Apr. 2009;30(4):173-81. doi: 10.1016/j.it.2009.01.007.
Liu et al., Calcineurin is a common target of cyclophilin-cyclosporin A and FKBP-FK506 complexes. Cell. Aug. 23, 1991;66(4):807-15. doi: 10.1016/0092-8674(91)90124-h.
Liu et al., CasX enzymes comprise a distinct family of RNA-guided genome editors. Nature. Feb. 2019;566(7743):218-223. doi: 10.1038/s41586-019-0908-x. Epub Feb. 4, 2019. Author manuscript entitled CRISPR-CasX is an RNA-dominated enzyme active for human genome editing.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Computational approaches for effective CRISPR guide RNA design and evaluation. Comput Struct Biotechnol J. Nov. 29, 2019;18:35-44. doi: 10.1016/j.csbj.2019.11.006.
Liu et al., Design of polydactyl zinc-finger proteins for unique addressing within complex genomes. Proc Natl Acad Sci U S A. May 27, 1997;94(11):5525-30.
Liu et al., Direct Promoter Repression by BCL11A Controls the Fetal to Adult Hemoglobin Switch. Cell. Apr. 5, 2018;173(2):430-442.e17. doi: 10.1016/j.cell.2018.03.016. Epub Mar. 29, 2018.
Liu et al., Distance determination by GIY-YIG intron endonucleases: discrimination between repression and cleavage functions. Nucleic Acids Res. Mar. 31, 2006;34(6):1755-64. Print 2006.
Liu et al., Editing DNA Methylation in the Mammalian Genome. Cell. Sep. 22, 2016;167(1):233-247.e17. doi: 10.1016/j.cell.2016.08.056.
Liu et al., Engineering a tRNA and aminoacyl-tRNA synthetase for the site-specific incorporation of unnatural amino acids into proteins in vivo. Proc Natl Acad Sci U S A. Sep. 16, 1997;94(19):10092-7.
Liu et al., Fast Colorimetric Sensing of Adenosine and Cocaine Based on a General Sensor Design Involving Aptamers and Nanoparticles. Angew Chem. Dec. 16, 2006;45(1):90-4. DOI: 10.1002/anie.200502589.
Liu et al., Fast Colorimetric Sensing of Adenosine and Cocaine Based on a General Sensor Design Involving Aptamers and Nanoparticles. Angew Chem. 2006;118(1):96-100.
Liu et al., Flap endonuclease 1: a central component of DNA metabolism. Annu Rev Biochem. 2004;73:589-615. doi:10.1146/annurev.biochem.73.012803.092453.
Liu et al., Functional Nucleic Acid Sensors. Chem Rev. May 2009;109(5):1948-98. doi: 10.1021/cr030183i.
Liu et al., Genetic incorporation of unnatural amino acids into proteins in mammalian cells. Nat Methods. Mar. 2007;4(3):239-44. Epub Feb. 25, 2007.
Liu et al., Highly efficient RNA-guided base editing in rabbit. Nat Commun. Jul. 13, 2018;9(1):2717. doi: 10.1038/s41467-018-05232-2.
Liu et al., Human BRCA2 protein promotes RAD51 filament formation on RPA-covered single-stranded DNA. Nat Struct Mol Biol. Oct. 2010;17(10):1260-2. doi: 10.1038/nsmb.1904. Epub Aug. 22, 2010.

(56) References Cited

OTHER PUBLICATIONS

Liu et al., Improving Editing Efficiency for the Sequences with NGH PAM Using xCas9-Derived Base Editors. Mol Ther Nucleic Acids. Sep. 6, 2019;17:626-635. doi: 10.1016/j.omtn.2019.06.024. Epub Jul. 12, 2019.
Liu et al., (6)-methyladenosine-dependent RNA structural switches regulate RNA-protein interactions. Nature. Feb. 26, 2015;518(7540):560-4. doi: 10.1038/nature14234.
Liu et al., Probing N6-methyladenosine RNA modification status at single nucleotide resolution in mRNA and long noncoding RNA. RNA. Dec. 2013;19(12):1848-56. doi: 10.1261/rna.041178.113. Epub Oct. 18, 2013.
Liu et al., Reverse transcriptase of foamy virus. Purification of the enzymes and immunological identification. Arch Virol. 1977;55(3):187-200. doi: 10.1007/BF01319905.
Liu et al., Reverse transcriptase-mediated tropism switching in Bordetella bacteriophage. Science. Mar. 15, 2002;295(5562):2091-4. doi: 10.1126/science.1067467.
Liu et al., *Saccharomyces cerevisiae* flap endonuclease 1 uses flap equilibration to maintain triplet repeat stability. Mol Cell Biol. May 2004;24(9):4049-64. doi: 10.1128/MCB.24.9.4049-4064.2004.
Liu et al., The Molecular Architecture for RNA-Guided RNA Cleavage by Cas13a. Cell. Aug. 10, 2017;170(4):714-726.e10. doi: 10.1016/j.cell.2017.06.050. Epub Jul. 27, 2017.
Loessner et al., Complete nucleotide sequence, molecular analysis and genome structure of bacteriophage A118 of Listeria monocytogenes: implications for phage evolution. Mol Microbiol. Jan. 2000;35(2):324-40. doi: 10.1046/j.1365-2958.2000.01720.x.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Long et al., Postnatal genome editing partially restores dystrophin expression in a mouse model of muscular dystrophy. Science. Jan. 22, 2016;351(6271):400-3. doi: 10.1126/science.aad5725. Epub Dec. 31, 2015.
Lopez-Girona et al., Cereblon is a direct protein target for immunomodulatory and antiproliferative activities of lenalidomide and pomalidomide. Leukemia. Nov. 2012;26(11):2326-35. doi: 10.1038/leu.2012.119. Epub May 3, 2012.
Lorenz et al., ViennaRNA Package 2.0. Algorithms Mol Biol. Nov. 24, 2011;6:26. doi: 10.1186/1748-7188-6-26.
Losey et al., Crystal structure of *Staphylococcus sureus* tRNA adenosine deaminase tadA in complex with RNA. Nature Struct. Mol. Biol. Feb. 2006;13(2):153-9.
Lu et al., Precise Editing of a Target Base in the Rice Genome Using a Modified CRISPR/Cas9 System. Mol Plant. Mar. 6, 2017;10(3):523-525. doi: 10.1016/j.molp.2016.11.013. Epub Dec. 6, 2016.
Luan et al., Reverse transcription of R2Bm RNA is primed by a nick at the chromosomal target site: a mechanism for non-LTR retrotransposition. Cell. Feb. 26, 1993;72(4):595-605. doi: 10.1016/0092-8674(93)90078-5.
Luckow et al., High level expression of nonfused foreign genes with Autographa californica nuclear polyhedrosis virus expression vectors. Virology. May 1989;170(1):31-9. doi: 10.1016/0042-6822(89)90348-6.
Lukacsovich et al., Repair of a specific double-strand break generated within a mammalian chromosome by yeast endonuclease I-Scel. Nucleic Acids Res. Dec. 25, 1994;22(25):5649-57. doi: 10.1093/nar/22.25.5649.
Lundberg et al., Delivery of short interfering RNA using endosomolytic cell-penetrating peptides. FASEB J. Sep. 2007;21(11):2664-71. Epub Apr. 26, 2007.
Lundquist et al., Site-directed mutagenesis and characterization of uracil-DNA glycosylase inhibitor protein. Role of specific carboxylic amino acids in complex formation with *Escherichia coli* uracil-DNA glycosylase. J Biol Chem. Aug. 22, 1997;272(34):21408-19.
Lynch, Evolution of the mutation rate. Trends Genet. Aug. 2010;26(8):345-52. doi: 10.1016/j.tig.2010.05.003. Epub Jun. 30, 2010.
Lyons et al., Efficient Recognition of an Unpaired Lesion by a DNA Repair Glycosylase. J. Am. Chem. Soc., 2009;131(49):17742-3. DOI: 10.1021/ja908378y.
Luke et al., Partial purification and characterization of the reverse transcriptase of the simian immunodeficiency virus TYO-7 isolated from an African green monkey. Biochemistry. Feb. 20, 1990;29(7):1764-9. doi: 10.1021/bi00459a015.
Ma et al., Human RAD52 interactions with replication protein A and the RAD51 presynaptic complex. J Biol Chem. Jul. 14, 2017;292(28):11702-11713. doi: 10.1074/jbc.M117.794545. Epub May 27, 2017.
Ma et al., Identification of pseudo attP sites for phage phiC31 integrase in bovine genome. Biochem Biophys Res Commun. Jul. 7, 2006;345(3):984-8. doi: 10.1016/j.bbrc.2006.04.145. Epub May 3, 2006.
Ma et al., In vitro protein engineering using synthetic tRNA(Ala) with different anticodons. Biochemistry. Aug. 10, 1993;32(31):7939-45.
Ma et al., PhiC31 integrase induces efficient site-specific recombination in the Capra hircus genome. DNA Cell Biol. Aug. 2014;33(8):484-91. doi: 10.1089/dna.2013.2124. Epub Apr. 22, 2014.
Ma et al., Single-Stranded DNA Cleavage by Divergent CRISPR-Cas9 Enzymes. Mol Cell. Nov. 5, 2015;60(3):398-407. doi: 10.1016/j.molcel.2015.10.030.
Ma et al., Targeted AID-mediated mutagenesis (TAM) enables efficient genomic diversification in mammalian cells. Nature Methods. Oct. 2016;13:1029-35. doi:10.1038/nmeth.4027.
Maas et al., Identification and characterization of a human tRNA-specific adenosine deaminase related to the ADAR family of pre-mRNA editing enzymes. Proc Natl Acad Sci U S A. Aug. 3, 1999;96(16):8895-900. doi: 10.1073/pnas.96.16.8895.
Macbeth et al., Inositol hexakisphosphate is bound in the ADAR2 core and required for RNA editing. Science. Sep. 2, 2005;309(5740):1534-9. doi: 10.1126/science.1113150.
Macrae et al., Ribonuclease revisited: structural insights into ribonuclease III family enzymes. Curr Opin Struct Biol. Feb. 2007;17(1):138-45. doi: 10.1016/j.sbi.2006.12.002. Epub Dec. 27, 2006.
Madura et al., Structural basis for ineffective T-cell responses to MHC anchor residue-improved "heteroclitic" peptides. Eur J Immunol. Feb. 2015;45(2):584-91. doi: 10.1002/eji.201445114. Epub Dec. 28, 2014.
Maeder et al., CRISPR RNA-guided activation of endogenous human genes. Nat Methods. Oct. 2013;10(10):977-9. doi: 10.1038/nmeth.2598. Epub Jul. 25, 2013.
Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Magin et al., Corf, the Rev/Rex homologue of HTDV/HERV-K, encodes an arginine-rich nuclear localization signal that exerts a trans-dominant phenotype when mutated. Virology. Aug. 15, 2000;274(1):11-6. doi: 10.1006/viro.2000.0438.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Maizels et al., Initiation of homologous recombination at DNA nicks. Nucleic Acids Res. Aug. 21, 2018;46(14):6962-6973. doi: 10.1093/nar/gky588.
Maji et al., A High-Throughput Platform to Identify Small-Molecule Inhibitors of CRISPR-Cas9. Cell. May 2, 2019;177(4):1067-1079.e19. doi: 10.1016/j.cell.2019.04.009.
Makarova et al., An updated evolutionary classification of CRISPR-Cas systems. Nat Rev Microbiol. Nov. 2015;13(11):722-36. doi: 10.1038/nrmicro3569. Epub Sep. 28, 2015.
Makarova et al., Classification and Nomenclature of CRISPR-Cas Systems: Where from Here? CRISPR J. Oct. 2018; 1(5):325-336. doi: 10.1089/crispr.2018.0033.

(56) References Cited

OTHER PUBLICATIONS

Makarova et al., Evolution and classification of the CRISPR-Cas systems. Nat Rev Microbiol. Jun. 2011;9(6):467-77. doi: 10.1038/nrmicro2577. Epub May 9, 2011.
Makarova et al., Prokaryotic homologs of Argonaute proteins are predicted to function as key components of a novel system of defense against mobile genetic elements. Biology Direct 2009;4:29. doi: 10.1186/1745-6150-4-29.
Makeyev et al., Evolutionary potential of an RNA virus. J Virol. Feb. 2004;78(4):2114-20.
Malashkevich et al., Crystal structure of tRNA adenosine deaminase TadA from *Escherichia coli*. Deposited: Mar. 10, 2005 Released: Feb. 21, 2006 doi:10.2210/pdb1z3a/pdb (2006).
Mali et al., Cas9 as a versatile tool for engineeringbiology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Malito et al., Structural basis for lack of toxicity of the diphtheria toxin mutant CRM197. Proc Natl Acad Sci U S A. Apr. 3, 2012;109(14):5229-34. doi: 10.1073/pnas.1201964109. Epub Mar. 19, 2012.
Mandal et al., Efficient ablation of genes in human hematopoietic stem and effector cells using CRISPR/Cas9. Cell Stem Cell. Nov. 6, 2014;15(5):643-52. doi: 10.1016/j.stem.2014.10.004. Epub Nov. 6, 2014.
Mandal et al., Riboswitches Control Fundamental Biochemical Pathways in Bacillus Subtilis and Other Bacteria. Cell. May 30, 2003;113(5):577-86. doi: 10.1016/s0092-8674(03)00391-x.
Mani et al., Design, engineering, and characterization of zinc finger nucleases. Biochem Biophys Res Commun. Sep. 23, 2005;335(2):447-57.
Marceau, Functions of single-strand DNA-binding proteins in DNA replication, recombination, and repair. Methods Mol Biol. 2012;922:1-21. doi: 10.1007/978-1-62703-032-8_1.
Maresca et al., Obligate ligation-gated recombination (ObLiGaRe): custom-designed nuclease-mediated targeted integration through nonhomologous end joining. Genome Res. Mar. 2013;23(3):539-46. Doi: 10.1101/gr.145441.112. Epub Nov. 14, 2012.
Marioni et al., DNA methylation age of blood predicts all-cause mortality in later life. Genome Biol. Jan. 30, 2015;16:25. doi: 10.1186/s13059-015-0584-6.
Marquart et al., Predicting base editing outcomes with an attention-based deep learning algorithm trained on high-throughput target library screeen. bioRxiv. Jul. 5, 2020. DOI:10.1101/2020.07.05.186544. Retrieved from the Internet via https://www.biorxiv.org/content/10.1101/2020.07.05.186544v1.full.pdf lased accessed on Apr. 28, 2021.
Marraffini et al., CRISPR interference limits horizontal gene transfer in staphylococci by targeting DNA. Science. Dec. 19, 2008;322(5909):1843-5. doi: 10.1126/science.1165771.
Marsden et al., The Tumor-Associated Variant RAD51 G151D Induces a Hyper-Recombination Phenotype. PLoS Genet. Aug. 11, 2016;12(8):e1006208. doi: 10.1371/journal.pgen.1006208.
Martinez et al., Hypermutagenesis of RNA using human immunodeficiency virus type 1 reverse transcriptase and biased dNTP concentrations. Proc Natl Acad Sci U S A. Dec. 6, 1994;91(25):11787-91. doi: 10.1073/pnas.91.25.11787.
Martsolf et al., Complete trisomy 17p a relatively new syndrome. Ann Genet. 1988;31(3):172-4.
Martz, L., Nav-i-gating antibodies for pain. Science-Business eXchange. Jun. 12, 2014;7(662):1-2. doi: 10.1038/scibx.2014.662.
Maruyama et al., Increasing the efficiency of precise genome editing with CRISPR-Cas9 by inhibition of nonhomologous end joining. Nat Biotechnol. May 2015;33(5):538-42. doi: 10.1038/nbt.3190. Epub Mar. 23, 2015.
Marzec et al., Prime Editing: A New Way for Genome Editing. Trends Cell Biol. Apr. 2020;30(4):257-259. doi: 10.1016/j.tcb.2020.01.004. Epub Jan. 27, 2020.
Mascola et al., HIV-1 neutralizing antibodies: understanding nature's pathways. Immunol Rev. Jul. 2013;254(1):225-44. doi: 10.1111/imr.12075.
Mason et al., Non-enzymatic roles of human RAD51 at stalled replication forks. bioRxiv. Jul. 31, 2019; doi.org/10.1101/359380. 36 pages. bioRxiv preprint first posted online Jul. 31, 2019.
Mathys et al., Characterization of a self-splicing mini-intein and its conversion into autocatalytic - and C-terminal cleavage elements: facile production of protein building blocks for protein ligation. Gene. Apr. 29, 1999;231(1-2):1-13. doi: 10.1016/s0378-1119(99)00103-1.
Matsuura et al., A gene essential for the site-specific excision of actinophage r4 prophage genome from the chromosome of a lysogen. J Gen Appl Microbiol. 1995;41(1):53-61.
Matthews, Structures of human ADAR2 bound to dsRNA reveal base-flipping mechanism and basis for site selectivity. Nat Struct Mol Biol. May 2016;23(5):426-33. doi: 10.1038/nsmb.3203. Epub Apr. 11, 2016.
May et al., Emergent lineages of mumps virus suggest the need for a polyvalent vaccine. Int J Infect Dis. Jan. 2018;66:1-4. doi: 10.1016/j.ijid.2017.09.024. Epub Oct. 4, 2017.
McCarroll et al., Copy-number variation and association studies of human disease. Nat Genet. Jul. 2007;39(7 Suppl):S37-42. doi: 10.1038/ng2080.
McDonald et al., Characterization of mutations at the mouse phenylalanine hydroxylase locus. Genomics. Feb. 1, 1997;39(3):402-5. doi: 10.1006/geno.1996.4508.
McInerney et al., Error Rate Comparison during Polymerase Chain Reaction by DNA Polymerase. Mol Biol Int. 2014;2014:287430. doi: 10.1155/2014/287430. Epub Aug. 17, 2014.
McKenna et al., Recording development with single cell dynamic lineage tracing. Development. Jun. 27, 2019;146(12):dev169730. doi: 10.1242/dev.169730.
McKenna et al., Whole-organism lineage tracing by combinatorial and cumulative genome editing. Science. Jul. 29, 2016;353(6298):aaf7907. doi: 10.1126/science.aaf7907. Epub May 26, 2016.
McNaughton et al., Mammalian cell penetration, siRNA transfection, and DNA transfection by supercharged proteins. Proc Natl Acad Sci U S A. Apr. 14, 2009;106(15):6111-6. doi: 10.1073/pnas.0807883106. Epub Mar. 23, 2009.
McVey et al., MMEJ repair of double-strand breaks (director's cut): deleted sequences and alternative endings. Trends Genet. Nov. 2008;24(11):529-38. doi: 10.1016/j.tig.2008.08.007. Epub Sep. 21, 2008.
Mead et al., A novel protective prion protein variant that colocalizes with kuru exposure. Engl J Med. Nov. 19, 2009;361(21):2056-65. doi: 10.1056/NEJMoa0809716.
Mei et al., Recent Progress in CRISPR/Cas9 Technology. J Genet Genomics. Feb. 20, 2016;43(2):63-75. doi: 10.1016/j.jgg.2016.01.001. Epub Jan. 18, 2016.
Meinke et al., Cre Recombinase and Other Tyrosine Recombinases. Chem Rev. Oct. 26, 2016;116(20):12785-12820. doi: 10.1021/acs.chemrev.6b00077. Epub May 10, 2016.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.
Menéndez-Arias, Mutation rates and intrinsic fidelity of retroviral reverse transcriptases. Viruses. Dec. 2009;1(3):1137-65. doi: 10.3390/v1031137. Epub Dec. 4, 2009.
Mercer et al., Chimeric TALE recombinases with programmable DNA sequence specificity. Nucleic Acids Res. Nov. 2012;40(21):11163-72. doi: 10.1093/nar/gks875. Epub Sep. 26, 2012.
Mertens et al., Site-specific recombination in bacteriophage Mu: characterization of binding sites for the DNA invertase Gin. EMBO J. Apr. 1988;7(4):1219-27.
Meyer et al., Breathing life into polycations: functionalization with pH-responsive endosomolytic peptides and polyethylene glycol enables siRNA delivery. J Am Chem Soc. Mar. 19, 2008;130(11):3272-3. doi: 10.1021/ja710344v. Epub Feb. 21, 2008.

(56) References Cited

OTHER PUBLICATIONS

Meyer et al., Comprehensive analysis of mRNA methylation reveals enrichment in 3' UTRs and near stop codons. Cell. Jun. 22, 2012;149(7):1635-46. doi: 10.1016/j.cell.2012.05.003. Epub May 17, 2012.
Meyer et al., Confirmation of a second natural preQ1 aptamer class in *Streptococcaceae* bacteria. RNA. Apr. 2008;14(4):685-95. doi: 10.1261/rna.937308. Epub Feb. 27, 2008.
Meyer et al., Library generation by gene shuffling. Curr Protoc Mol Biol. Jan. 6, 2014;105: Unit 15.12 . . . doi: 10.1002/0471142727.mb1512s105.
Meyer et al., Ribosome biogenesis factor Tsr3 is the aminocarboxypropyl transferase responsible for 18S rRNA hypermodification in yeast and humans. Nucleic Acids Res. May 19, 2016;44(9):4304-16. doi: 10.1093/nar/gkw244. Epub Apr. 15, 2016.
Meyer et al., The dynamic epitranscriptome: N6-methyladenosine and gene expression control. Nat Rev Mol Cell Biol. May 2014;15(5):313-26. doi: 10.1038/nrm3785. Epub Apr. 9, 2014.
Michel et al., Mitochondrial class II introns encode proteins related to the reverse transcriptases of retroviruses. Nature. Aug. 15-21, 1985;316(6029):641-3. doi: 10.1038/316641a0.
Midoux et al., Chemical vectors for gene delivery: a current review on polymers, peptides and lipids containing histidine or imidazole as nucleic acids carriers. Br J Pharmacol. May 2009;157(2):166-78. doi: 10.1111/j.1476-5381.2009.00288.x.
Mihai et al., PTEN inhibition improves wound healing in lung epithelia through changes in cellular mechanics that enhance migration. Am J Physiol Lung Cell Mol Physiol. 2012;302(3):L287-L299.
Mijakovic et al., Bacterial single-stranded DNA-binding proteins are phosphorylated on tyrosine. Nucleic Acids Res. Mar. 20, 2006;34(5):1588-96. doi: 10.1093/nar/gkj514.
Miller et al., A Tale nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Miller et al., Construction and properties of retrovirus packaging cells based on gibbon ape leukemia virus. J Virol. May 1991;65(5):2220-4. doi: 10.1128/JVI.65.5.2220-2224.1991.
Miller et al., Continuous evolution of SpCas9 variants compatible with non-G PAMs. Nat Biotechnol. Apr. 2020;38(4):471-481. doi: 10.1038/s41587-020-0412-8. Epub Feb. 10, 2020.
Miller et al., Phage-assisted continuous and non-continuous evolution. Nat Protoc. Dec. 2020;15(12):4101-4127. doi: 10.1038/s41596-020-00410-3. Epub Nov. 16, 2020.
Miller, Human gene therapy comes of age. Nature. Jun. 11, 1992;357(6378):455-60. doi: 10.1038/357455a0.
Mills et al., Protein splicing in trans by purified - and C-terminal fragments of the *Mycobacterium tuberculosis* RecA intein. Proc Natl Acad Sci U S A. Mar. 31, 1998;95(7):3543-8. doi: 10.1073/pnas.95.7.3543.
Minoche et al., Evaluation of genomic high-throughput sequencing data generated on Illumina HiSeq and genome analyzer systems. Genome Biol. Nov. 8, 2011;12(11):R112. doi: 10.1186/GB-2011-12-11-r112.
Minoretti et al., A W148R mutation in the human FOXD4 gene segregating with dilated cardiomyopathy, obsessive-compulsive disorder, and suicidality. Int J Mol Med. Mar. 2007;19(3):369-72.
Mir et al., Two Active Site Divalent Ions in the Crystal Structure of the Hammerhead Ribozyme Bound to a Transition State Analogue. Biochemistry . . . Feb. 2, 2016;55(4):633-6. doi: 10.1021/acs.biochem.5b01139. Epub Jan. 19, 2016.
Mir et al., Type II-C CRISPR-Cas9 Biology, Mechanism, and Application. ACS Chem Biol. Feb. 16, 2018;13(2):357-365. doi: 10.1021/acschembio.7b00855. Epub Dec. 20, 2017.
Mishina et al., Conditional gene targeting on the pure C57BL/6 genetic background. Neurosci Res. Jun. 2007;58(2):105-12. doi: 10.1016/j.neures.2007.01.004. Epub Jan. 18, 2007.
Mitani et al., Delivering therapeutic genes—matching approach and application. Trends Biotechnol. May 1993;11(5):162-6. doi: 10.1016/0167-7799(93)90108-L.
Mitton-Fry et al., Poly(A) tail recognition by a viral RNA element through assembly of a triple helix. Science. Nov. 26, 2010;330(6008):1244-7. doi: 10.1126/science.1195858.
Miyaoka et al., Systematic quantification of HDR and NHEJ reveals effects of locus, nuclease, and cell type on genome-editing. Sci Rep. Mar. 31, 2016;6:23549. doi: 10.1038/srep23549.
Moede et al., Identification of a nuclear localization signal, RRMKWKK, in the homeodomain transcription factor PDX-1. FEBS Lett. Nov. 19, 1999;461(3):229-34. doi: 10.1016/s0014-5793(99)01446-5.
Mohr et al., A Reverse Transcriptase-Cas1 Fusion Protein Contains a Cas6 Domain Required for Both CRISPR RNA Biogenesis and RNA Spacer Acquisition. Mol Cell. Nov. 15, 2018;72(4):700-714.e8. doi: 10.1016/j.molcel.2018.09.013. Epub Oct. 18, 2018. Including Supplemental Information.
Mohr et al., Thermostable group II intron reverse transcriptase fusion proteins and their use in cDNA synthesis and next-generation RNA sequencing. RNA. Jul. 2013;19(7):958-70. doi: 10.1261/rna.039743.113. Epub May 22, 2013.
Mojica et al., Intervening sequences of regularly spaced prokaryotic repeats derive from foreign genetic elements. J Mol Evol. Feb. 2005;60(2):174-82.
Mok et al., A bacterial cytidine deaminase toxin enables CRISPR-free mitochondrial base editing. Nature. Jul. 2020;583(7817):631-637. doi: 10.1038/s41586-020-2477-4. Epub Jul. 8, 2020.
Mol et al., Crystal structure and mutational analysis of human uracil-DNA glycosylase: structural basis for specificity and catalysis. Cell. Mar. 24, 1995;80(6):869-78. doi: 10.1016/0092-8674(95)90290-2.
Mol et al., Crystal structure of human uracil-DNA glycosylase in complex with a protein inhibitor: protein mimicry of DNA. Cell. Sep. 8, 1995;82(5):701-8.
Molla et al., CRISPR/Cas-Mediated Base Editing: Technical Considerations and Practical Applications. Trends Biotechnol. Oct. 2019;37(10):1121-1142. doi: 10.1016/j.tibtech.2019.03.008. Epub Apr. 14, 2019.
Monahan et al., Site-specific incorporation of unnatural amino acids into receptors expressed in Mammalian cells. Chem Biol. Jun. 2003;10(6):573-80.
Monot et al., The specificity and flexibility of l1 reverse transcription priming at imperfect T-tracts. PLoS Genet. May 2013;9(5):e1003499. doi: 10.1371/journal.pgen.1003499. Epub May 9, 2013.
Montange et al., Structure of the S-adenosylmethionine riboswitch regulatory mRNA element. Nature. Jun. 29, 2006;441(7097):1172-5.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Mootz et al., Conditional protein splicing: a new tool to control protein structure and function in vitro and in vivo. J Am Chem Soc. Sep. 3, 2003;125(35):10561-9.
Mootz et al., Protein splicing triggered by a small molecule. J Am Chem Soc. Aug. 7, 2002;124(31):9044-5 and Supporting Information. doi: 10.1021/ja0267690. 4 pages.
Mootz et al., Protein splicing triggered by a small molecule. J Am Chem Soc. Aug. 7, 2002;124(31):9044-5.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Moreno-Mateos et al., CRISPRscan: designing highly efficient sgRNAs for CRISPR-Cas9 targeting in vivo. Nat Methods. Oct. 2015;12(10):982-8. doi: 10.1038/nmeth.3543. Epub Aug. 31, 2015.
Morita et al., The site-specific recombination system of actinophage TG1. FEMS Microbiol Lett. Aug. 2009;297(2):234-40. doi: 10.1111/j.1574-6968.2009.01683.x.
Morris et al., A peptide carrier for the delivery of biologically active proteins into mammalian cells. Nat Biotechnol. Dec. 2001;19(12):1173-6.

(56) References Cited

OTHER PUBLICATIONS

Moscou et al., A simple cipher governs DNA recognition by TAL effectors. Science. Dec. 11, 2009;326(5959):1501. doi: 10.1126/science.1178817.
Mougiakos et al., Characterizing a thermostable Cas9 for bacterial genome editing and silencing. Nat Commun. Nov. 21, 2017;8(1):1647. doi: 10.1038/s41467-017-01591-4.
Muir et al., Expressed protein ligation: a general method for protein engineering. Proc Natl Acad Sci U S A. Jun. 9, 1998;95(12):6705-10. doi: 10.1073/pnas.95.12.6705.
Muller et al., Nucleotide exchange and excision technology (NExT) DNA shuffling: a robust method for DNA fragmentation and directed evolution. Nucleic Acids Res. Aug. 1, 2005;33(13):e117. doi: 10.1093/nar/gni116. PMID: 16061932; PMCID: PMC1182171.
Muller, U.F., Design and Experimental Evolution of trans-Splicing Group I Intron Ribozymes. Molecules. Jan. 2, 2017;22(1):75. doi: 10.3390/molecules22010075.
Mullins et al., Transgenesis in nonmurine species. Hypertension. Oct. 1993;22(4):630-3.
Mumtsidu et al., Structural features of the single-stranded DNA-binding protein of Epstein-Barr virus. J Struct Biol. Feb. 2008;161(2):172-87. doi: 10.1016/j.jsb.2007.10.014. Epub Nov. 1, 2007.
Murphy, Phage recombinases and their applications. Adv Virus Res. 2012;83:367-414. doi: 10.1016/B978-0-12-394438-2.00008-6. Review.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
Muzyczka et al., Adeno-associated virus (AAV) vectors: will they work? J Clin Invest. Oct. 1994;94(4):1351. doi: 10.1172/JCI117468.
Myerowitz et al., The major defect in Ashkenazi Jews with Tay-Sachs disease is an insertion in the gene for the alpha-chain of beta-hexosaminidase. J Biol Chem. Dec. 15, 1988;263(35):18587-9.
Myers et al., Insulin signal transduction and the IRS proteins. Annu Rev Pharmacol Toxicol. 1996;36:615-58. doi: 10.1146/annurev.pa.36.040196.003151.
Nabel et al., Direct gene transfer for immunotherapy and immunization. Trends Biotechnol. May 1993;11(5):211-5. doi: 10.1016/0167-7799(93)90117-R.
Nahar et al., A G-quadruplex motif at the 3' end of sgRNAs improves CRISPR-Cas9 based genome editing efficiency. Chem Commun (Camb). Mar. 7, 2018;54(19):2377-2380. doi: 10.1039/c7cc08893k. Epub Feb. 16, 2018.
Nahvi et al., Coenzyme B12 riboswitches are widespread genetic control elements in prokaryotes. Nucleic Acids Res. Jan. 2, 2004;32(1):143-50.
Nakade et al., Microhomology-mediated end-joining-dependent integration of donor DNA in cells and animals using TALENs and CRISPR/Cas9. Nat Commun. Nov. 20, 2014;5:5560. doi: 10.1038/ncomms6560.
Nakamura et al., Codon usage tabulated from international DNA sequence databases: status for the year 2000. Nucleic Acids Res. Jan. 1, 2000;28(1):292. doi: 10.1093/nar/28.1.292.
Naorem et al., DGR mutagenic transposition occurs via hypermutagenic reverse transcription primed by nicked template RNA. Proc Natl Acad Sci U S A. Nov. 21, 2017;114(47):E10187-E10195. doi: 10.1073/pnas.1715952114. Epub Nov. 6, 2017.
Narayanan et al., Clamping down on weak terminal base pairs: oligonucleotides with molecular caps as fidelity-enhancing elements at the 5'- and 3'-terminal residues. Nucleic Acids Res. May 20, 2004;32(9):2901-11. Print 2004.
Navaratnam et al., An overview of cytidine deaminases. Int J Hematol. Apr. 2006;83(3):195-200.
NCBI Reference Sequence: NM_002427.3. Wu et al., May 3, 2014. 5 pages.
Neel et al., Riboswitches: Classification, function and in silico approach, International Journal of Pharma Sciences and Research. 2010;1(9):409-420.
Nelson et al., Engineered pegRNAs improve prime editing efficiency. Nat Biotechnol. Oct. 4, 2021. doi: 10.1038/s41587-021-01039-7. Epub ahead of print. Erratum in: Nat Biotechnol. Dec. 8, 2021. 14 pages.
Nelson et al., Filamentous phage DNA cloning vectors: a noninfective mutant with a nonpolar deletion in gene III. Virology. 1981; 108(2): 338-50.
Nelson et al., The unstable repeats—three evolving faces of neurological disease. Neuron. Mar. 6, 2013;77(5):825-43. doi: 10.1016/j.neuron.2013.02.022.
Nern et al., Multiple new site-specific recombinases for use in manipulating animal genomes. Proc Natl Acad Sci U S A. Aug. 23, 2011;108(34):14198-203. doi: 10.1073/pnas.1111704108. Epub Aug. 9, 2011.
Newby et al., Base editing of haematopoietic stem cells rescues sickle cell disease in mice. Nature. Jun. 2, 2021. doi: 10.1038/s41586-021-03609-w. Epub ahead of print.
Nguyen et al., Evolutionary drivers of thermoadaptation in enzyme catalysis. Science. Jan. 20, 2017;355(6322):289-294. doi: 10.1126/science.aah3717. Epub Dec. 22, 2016.
Nguyen et al., IQ-TREE: a fast and effective stochastic algorithm for estimating maximum-likelihood phylogenies. Mol Biol Evol. Jan. 2015;32(1):268-74. doi: 10.1093/molbev/msu300. Epub Nov. 3, 2014.
Ni et al., A PCSK9-binding antibody that structurally mimics the EGF(A) domain of LDL-receptor reduces LDL cholesterol in vivo. J Lipid Res. 2011;52:76-86.
Ni et al., Nucleic acid aptamers: clinical applications and promising new horizons. Curr Med Chem. 2011;18(27):4206-14. Review.
Nishida et al., Targeted nucleotide editing using hybrid prokaryotic and vertebrate adaptive immune systems. Science. Sep. 16, 2016;353(6305):1248. pii: aaf8729. doi: 10.1126/science.aaf8729. Epub Aug. 4, 2016.
Nishikura, Functions and regulation of RNA editing by ADAR deaminases. Annu Rev Biochem. 2010;79:321-349. doi:10.1146/annurev-biochem-060208-105251.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Nishimasu et al., Crystal Structure of *Staphylococcus aureus* Cas9. Cell. Aug. 27, 2015;162(5):1113-26. doi: 10.1016/j.cell.2015.08.007.
Nishimasu et al., Engineered CRISPR-Cas9 nuclease with expanded targeting space. Science. Sep. 21, 2018;361(6408):1259-1262. doi: 10.1126/science.aas9129. Epub Aug. 30, 2018.
Noack et al., Epitranscriptomics: A New Regulatory Mechanism of Brain Development and Function. Front Neurosci. Feb. 20, 2018;12:85. doi: 10.3389/fnins.2018.00085. 9 pages.
Nomura et al., Controlling Mammalian Gene Expression by Allosteric Hepatitis Delta Virus Ribozymes. ACS Synth Biol. Dec. 20, 2013;2(12):684-9. doi: 10.1021/sb400037a. Epub May 22, 2013.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Noris et al., A phenylalanine-55 to serine amino-acid substitution in the human glycoprotein IX leucine-rich repeat is associated with Bernard-Soulier syndrome. Br J Haematol. May 1997;97(2):312-20.
Nottingham et al., RNA-seq of human reference RNA samples using a thermostable group II intron reverse transcriptase. RNA. Apr. 2016;22(4):597-613. doi: 10.1261/rna.055558.115. Epub Jan. 29, 2016.
Nowak et al., Characterization of single-stranded DNA-binding proteins from the psychrophilic bacteria Desulfotalea psychrophila, Flavobacterium psychrophilum, Psychrobacter arcticus, Psychrobacter cryohalolentis, Psychromonas ingrahamii, Psychroflexus torquis, and Photobacterium profundum. BMC Microbiol. Apr. 14, 2014;14:91. doi: 10.1186/1471-2180-14-91.
Nowak et al., Guide RNA Engineering for Versatile Cas9 Functionality. Nucleic Acids Res. Nov. 16, 2016;44(20):9555-9564. doi: 10.1093/nar/gkw908. Epub Oct. 12, 2016.

(56) References Cited

OTHER PUBLICATIONS

Nowak et al., Structural analysis of monomeric retroviral reverse transcriptase in complex with an RNA/DNA hybrid. Nucleic Acids Res. Apr. 1, 2013;41(6):3874-87. doi: 10.1093/nar/gkt053. Epub Feb. 4, 2013.
Numrych et al., A comparison of the effects of single-base and triple-base changes in the integrase arm-type binding sites on the site-specific recombination of bacteriophage lambda. Nucleic Acids Res. Jul. 11, 1990;18(13):3953-9. doi: 10.1093/nar/18.13.3953.
Nyerges et al., A highly precise and portable genome engineering method allows comparison of mutational effects across bacterial species. Proc Natl Acad Sci U S A. Mar. 1, 2016;113(9):2502-7. doi: 10.1073/pnas.1520040113. Epub Feb. 16, 2016.
O'Connell et al., Programmable RNA recognition and cleavage by CRISPR/Cas9. Nature. Dec. 11, 2014;516(7530):263-6. doi: 10.1038/nature13769. Epub Sep. 28, 2014.
O'Maille et al., Structure-based combinatorial protein engineering (SCOPE). J Mol Biol. Aug. 23, 2002;321(4):677-91.
Oakes et al., CRISPR-Cas9 Circular Permutants as Programmable Scaffolds for Genome Modification. Cell. Jan. 10, 2019;176(1-2):254-267.e16. doi: 10.1016/j.cell.2018.11.052.
Oakes et al., Profiling of engineering hotspots identifies an allosteric CRISPR-Cas9 switch. Nat Biotechnol. Jun. 2016;34(6):646-51. doi: 10.1038/nbt.3528. Epub May 2, 2016.
Oakes et al., Protein engineering of Cas9 for enhanced function. Methods Enzymol. 2014;546:491-511.
Odsbu et al., Specific-terminal interactions of the *Escherichia coli* SeqA protein are required to form multimers that restrain negative supercoils and form foci. Genes Cells. Nov. 2005;10(11):1039-49.
Oeemig et al., Solution structure of DnaE intein from Nostoc punctiforme: structural basis for the design of a new split intein suitable for site-specific chemical modification. FEBS Lett. May 6, 2009;583(9):1451-6.
Offord, Advances in Genome Editing. The Scientist, Apr. 20, 2016. http://www.the-scientist.com/?articles.view/articleNo/45903/title/Advances-in-Genome-Editing/.
Oh et al., Positional cloning of a gene for Hermansky-Pudlak syndrome, a disorder of cytoplasmic organelles. Nat Genet. Nov. 1996;14(3):300-6. doi: 10.1038/ng1196-300.
Ohe et al., Purification and properties of xanthine dehydrogenase from Streptomyces cyanogenus. J Biochem. Jul. 1979;86(1):45-53.
Olivares et al., Site-specific genomic integration produces therapeutic Factor IX levels in mice. Nat Biotechnol. Nov. 2002;20(11):1124-8. doi: 10.1038/nbt753. Epub Oct. 15, 2002.
Olorunniji et al., Purification and In Vitro Characterization of Zinc Finger Recombinases. Methods Mol Biol. 2017;1642:229-245. doi: 10.1007/978-1-4939-7169-5_15.
Olorunniji et al., Site-specific recombinases: molecular machines for the Genetic Revolution. Biochem J. Mar. 15, 2016;473(6):673-84. doi: 10.1042/BJ20151112.
Olorunniji et al., Synapsis and catalysis by activated Tn3 resolvase mutants. Nucleic Acids Res. Dec. 2008;36(22):7181-91. doi: 10.1093/nar/gkn885. Epub Nov. 10, 2008.
Orlando et al., Zinc-finger nuclease-driven targeted integration into mammalian genomes using donors with limited chromosomal homology. Nucleic Acids Res. Aug. 2010;38(15):e152. doi: 10.1093/nar/gkq512. Epub Jun. 8, 2010.
Orthwein et al., A mechanism for the suppression of homologous recombination in G1 cells. Nature. Dec. 17, 2015;528(7582):422-6. doi: 10.1038/nature16142. Epub Dec. 9, 2015.
Ortiz-Urda et al., Stable nonviral genetic correction of inherited human skin disease. Nat Med. Oct. 2002;8(10):1166-70. doi: 10.1038/nm766. Epub Sep. 16, 2002. Erratum in: Nat Med. Feb. 2003;9(2):237.
Osborn et al., Base Editor Correction of COL7A1 in Recessive Dystrophic Epidermolysis Bullosa Patient-Derived Fibroblasts and iPSCs. J Invest Dermatol. Feb. 2020;140(2):338-347.e5. doi: 10.1016/j.jid.2019.07.701. Epub Aug. 19, 2019.
Osborn et al., TALEN-based gene correction for epidermolysis bullosa. Mol Ther. Jun. 2013;21(6):1151-9. doi: 10.1038/mt.2013.56. Epub Apr. 2, 2013.
Ostermeier et al., A combinatorial approach to hybrid enzymes independent of DNA homology. Nat Biotechnol. Dec. 1999;17(12):1205-9.
Ostertag et al., Biology of mammalian L1 retrotransposons. Annu Rev Genet. 2001;35:501-38. doi: 10.1146/annurev.genet.35.102401.091032.
Otomo et al., Improved segmental isotope labeling of proteins and application to a larger protein. J Biomol NMR. Jun. 1999;14(2):105-14. doi: 10.1023/a:1008308128050.
Otomo et al., NMR observation of selected segments in a larger protein: central-segment isotope labeling through intein-mediated ligation. Biochemistry. Dec. 7, 1999;38(49):16040-4. doi: 10.1021/bi991902j.
Otto et al., The probability of fixation in populations of changing size. Genetics. Jun. 1997;146(2):723-33.
Packer et al., Methods for the directed evolution of proteins. Nat Rev Genet. Jul. 2015;16(7):379-94. doi: 10.1038/nrg3927. Epub Jun. 9, 2015.
Packer et al., Phage-assisted continuous evolution of proteases with altered substrate specificity. Nat Commun. Oct. 16, 2017;8(1):956. doi: 10.1038/s41467-017-01055-9.
Paige et al., RNA mimics of green fluorescent protein. Science. Jul. 29, 2011;333(6042):642-6. doi:10.1126/science.1207339.
Paiva et al., Targeted protein degradation: elements of PROTAC design. Curr Opin Chem Biol. Jun. 2019;50:111-119. doi: 10.1016/j.cbpa.2019.02.022. Epub Apr. 17, 2019.
Pan et al., Biological and biomedical applications of engineered nucleases. Mol Biotechnol. Sep. 2013;55(1):54-62. doi: 10.1007/s12033-012-9613-9.
Paquet et al., Efficient introduction of specific homozygous and heterozygous mutations using CRISPR/Cas9. Nature. May 5, 2016;533(7601):125-9. doi: 10.1038/nature17664. Epub Apr. 27, 2016.
Park et al., Digenome-seq web tool for profiling CRISPR specificity. Nat Methods. May 30, 2017;14(6):548-549. doi: 10.1038/nmeth.4262.
Park et al., Highly efficient editing of the ?-globin gene in patient-derived hematopoietic stem and progenitor cells to treat sickle cell disease. Nucleic Acids Res. Sep. 5, 2019;47(15):7955-7972. doi: 10.1093/nar/gkz475.
Park et al., Sendai virus, an RNA virus with no risk of genomic integration, delivers CRISPR/Cas9 for efficient gene editing. Mol Ther Methods Clin Dev. Aug. 24, 2016;3:16057. doi: 10.1038/mtm.2016.57.
Parker et al., Admixture mapping identifies a quantitative trait locus associated with FEV1/FVC in the COPDGene Study. Genet Epidemiol. Nov. 2014;38(7):652-9. doi: 10.1002/gepi.21847. Epub Aug. 11, 2014.
Patel et al., Flap endonucleases pass 5'-flaps through a flexible arch using a disorder-thread-order mechanism to confer specificity for free 5'-ends. Nucleic Acids Res. May 2012;40(10):4507-19. doi: 10.1093/nar/gks051. Epub Feb. 8, 2012.
Pattanayak et al., Determining the specificities of TALENs, Cas9, and other genome-editing enzymes. Methods Enzymol. 2014;546:47-78. doi: 10.1016/B978-0-12-801185-0.00003-9.
Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.
Pattanayak et al., Revealing off-target cleavage specificities of zinc-finger nucleases by in vitro selection. Nat Methods. Aug. 7, 2011;8(9):765-70. doi: 10.1038/nmeth.1670.
Pavletich et al., Zinc finger-DNA recognition: crystal structure of a Zif268-DNA complex at 2.1 A. Science. May 10, 1991;252(5007):809-17.
Pawson et al., Protein phosphorylation in signaling—50 years and counting. Trends Biochem Sci. Jun. 2005;30(6):286-90. doi: 10.1016/j.tibs.2005.04.013.
Pearl, Structure and function in the uracil-DNA glycosylase superfamily. Mutat Res. Aug. 30, 2000;460(3-4):165-81.
Peck et al., Directed evolution of a small-molecule-triggered intein with improved splicing properties in mammalian cells. Chem Biol. May 27, 2011;18(5):619-30. doi: 10.1016/j.chembiol.2011.02.014.

(56) References Cited

OTHER PUBLICATIONS

Pellegrini et al., Insights into DNA recombination from the structure of a RAD51-BRCA2 complex. Nature. Nov. 21, 2002;420(6913):287-93. doi: 10.1038/nature01230. Epub Nov. 10, 2002.
Pellenz et al., New human chromosomal safe harbor sites for genome engineering with CRISPR/Cas9, TAL effector and homing endonucleases. Aug. 20, 2018. bioRxiv doi: https://doi.org/10.1101/396390.
Pelletier, CRISPR-Cas systems for the study of the immune function. Nov. 15, 2016. https://doi.org/10.1002/9780470015902.a0026896.
Pennisi et al., The CRISPR craze. Science. Aug. 23, 2013;341(6148):833-6. doi: 10.1126/science.341.6148.833.
Pennisi et al., The tale of the TALEs. Science. Dec. 14, 2012;338(6113):1408-11. doi: 10.1126/science.338.6113.1408.
Perach et al., Catalytic features of the recombinant reverse transcriptase of bovine leukemia virus expressed in bacteria. Virology. Jun. 20, 1999;259(1):176-89. doi: 10.1006/viro.1999.9761.
Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.
Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.
Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.
Perler et al., Protein splicing and autoproteolysis mechanisms. Curr Opin Chem Biol. Oct. 1997;1(3):292-9. doi: 10.1016/s1367-5931(97)80065-8.
Perler et al., Protein splicing elements: inteins and exteins—a definition of terms and recommended nomenclature. Nucleic Acids Res. Apr. 11, 1994;22(7):1125-7. doi: 10.1093/nar/22.7.1125.
Perler, InBase, the New England Biolabs Intein Database. Nucleic Acids Res. Jan. 1, 1999;27(1):346-7. doi: 10.1093/nar/27.1.346.
Perler, Protein splicing of inteins and hedgehog autoproteolysis: structure, function, and evolution. Cell. Jan. 9, 1998;92(1):1-4. doi: 10.1016/s0092-8674(00)80892-2.
Perreault et al., Mixed deoxyribo- and ribo-oligonucleotides with catalytic activity. Nature. Apr. 5, 1990;344(6266):565-7. doi: 10.1038/344565a0.
Petek et al., Frequent endonuclease cleavage at off-target locations in vivo. Mol Ther. May 2010;18(5):983-6. Doi: 10.1038/mt.2010.35. Epub Mar. 9, 2010.
Petersen-Mahrt et al., AID mutates *E. coli* suggesting a DNA deamination mechanism for antibody diversification. Nature. Jul. 4, 2002;418(6893):99-103.
Petolino et al., Editing Plant Genomes: a new era of crop improvement. Plant Biotechnol J. Feb. 2016;14(2):435-6. doi: 10.1111/pbi.12542.
Peyrottes et al., Oligodeoxynucleoside phosphoramidates (P-NH2): synthesis and thermal stability of duplexes with DNA and RNA targets. Nucleic Acids Res. May 15, 1996;24(10):1841-8.
Pfeiffer et al., Mechanisms of DNA double-strand break repair and their potential to induce chromosomal aberrations. Mutagenesis. Jul. 2000;15(4):289-302. doi: 10.1093/mutage/15.4.289.
Phillips, The challenge of gene therapy and DNA delivery. J Pharm Pharmacol. Sep. 2001;53(9):1169-74.
Pickart et al., Ubiquitin: structures, functions, mechanisms. Biochim Biophys Acta. Nov. 29, 2004;1695(1-3):55-72. doi: 10.1016/j.bbamcr.2004.09.019.
Pieken et al., Kinetic characterization of ribonuclease-resistant 2'-modified hammerhead ribozymes. Science. Jul. 19, 1991;253(5017):314-7. doi: 10.1126/science.1857967.
Pinkert et al., An albumin enhancer located 10 kb upstream functions along with its promoter to direct efficient, liver-specific expression in transgenic mice. Genes Dev. May 1987;1(3):268-76. doi: 10.1101/gad.1.3.268.
Pirakitikulr et al., PCRless library mutagenesis via oligonucleotide recombination in yeast. Protein Sci. Dec. 2010;19(12):2336-46. doi: 10.1002/pro.513.
Plasterk et al., DNA inversions in the chromosome of *Escherichia coli* and in bacteriophage Mu: relationship to other site-specific recombination systems. Proc Natl Acad Sci U S A. Sep. 1983;80(17):5355-8.
Plosky et al., CRISPR-Mediated Base Editing without DNA Double-Strand Breaks. Mol Cell. May 19, 2016;62(4):477-8. doi: 10.1016/j.molcel.2016.05.006.
Pluciennik et al., PCNA function in the activation and strand direction of MutLa endonuclease in mismatch repair. Proc Natl Acad Sci U S A. Sep. 14, 2010;107(37):16066-71. doi: 10.1073/pnas.1010662107. Epub Aug. 16, 2010.
Poller et al., A leucine-to-proline substitution causes a defective alpha 1-antichymotrypsin allele associated with familial obstructive lung disease. Genomics. Sep. 1993;17(3):740-3.
Popp et al., Sortagging: a versatile method for protein labeling. Nat Chem Biol. Nov. 2007;3(11):707-8. doi: 10.1038/nchembio.2007.31. Epub Sep. 23, 2007.
Porteus, Design and testing of zinc finger nucleases for use in mammalian cells. Methods Mol Biol. 2008;435:47-61. doi: 10.1007/978-1-59745-232-8_4.
Posnick et al., Imbalanced base excision repair increases spontaneous mutation and alkylation sensitivity in *Escherichia coli*. J Bacteriol. Nov. 1999;181(21):6763-71.
Pospísilová et al., Hydrolytic cleavage of N6-substituted adenine derivatives by eukaryotic adenine and adenosine deaminases. Biosci Rep. 2008;28(6):335-347. doi:10.1042/BSR20080081.
Pourcel et al., CRISPR elements in Yersinia pestis acquire new repeats by preferential uptake of bacteriophage DNA, and provide additional tools for evolutionary studies. Microbiology. Mar. 2005;151(Pt 3):653-63.
Prasad et al., Rev1 is a base excision repair enzyme with 5'-deoxyribose phosphate lyase activity. Nucleic Acids Res. Dec. 15, 2016;44(22):10824-10833. doi: 10.1093/nar/gkw869. Epub Sep. 28, 2016.
Prasad et al., Visualizing the assembly of human Rad51 filaments on double-stranded DNA. J Mol Biol. Oct. 27, 2006;363(3):713-28. doi: 10.1016/j.jmb.2006.08.046. Epub Aug. 22, 2006.
Prashant et al., CAS9 transcriptional activators for target specificity screening and paired nickases for cooperative genome engineering. Nature Biotechnology 2013;31(9):833-8.
Prorocic et al., Zinc-finger recombinase activities in vitro. Nucleic Acids Res. Nov. 2011;39(21):9316-28. doi: 10.1093/nar/gkr652. Epub Aug. 17, 2011.
Proudfoot et al., Zinc finger recombinases with adaptable DNA sequence specificity. PLoS One. Apr. 29, 2011;6(4):e19537. doi: 10.1371/journal.pone.0019537.
Pruschy et al., Mechanistic studies of a signaling pathway activated by the organic dimerizer FK1012. Chem Biol. Nov. 1994;1(3):163-72. doi: 10.1016/1074-5521(94)90006-x.
Prykhozhij et al., CRISPR multitargeter: a web tool to find common and unique CRISPR single guide RNA targets in a set of similar sequences. PLoS One. Mar. 5, 2015;10(3):e0119372. doi: 10.1371/journal.pone.0119372. eCollection 2015.
Pu et al., Evolution of a split RNA polymerase as a versatile biosensor platform. Nat Chem Biol. Apr. 2017;13(4):432-438. doi: 10.1038/nchembio.2299. Epub Feb. 13, 2017.
Putnam et al., Protein mimicry of DNA from crystal structures of the uracil-DNA glycosylase inhibitor protein and its complex with *Escherichia coli* uracil-DNA glycosylase. J Mol Biol. Mar. 26, 1999;287(2):331-46.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Qi et al., Repurposing CRISPR as an RNA-guided platform for sequence-specific control of gene expression. Cell. Feb. 28, 2013;152(5):1173-83. doi: 10.1016/j.cell.2013.02.022.
Qu et al., Global mapping of binding sites for phic31 integrase in transgenic maden-darby bovine kidney cells using ChIP-seq. Hereditas. Jan. 14, 2019;156:3. doi: 10.1186/s41065-018-0079-z.

(56) References Cited

OTHER PUBLICATIONS

Queen et al., Immunoglobulin gene transcription is activated by downstream sequence elements. Cell. Jul. 1983;33(3):741-8. doi: 10.1016/0092-8674(83)90016-8.
Radany et al., Increased spontaneous mutation frequency in human cells expressing the phage PBS2-encoded inhibitor of uracil-DNA glycosylase. Mutat Res. Sep. 15, 2000;461(1):41-58. doi: 10.1016/s0921-8777(00)00040-9.
Raghavan et al., Abstract 27: Therapeutic Targeting of Human Lipid Genes with in vivo CRISPR-Cas9 Genome Editing. Oral Abstract Presentations: Lipoprotein Metabolism and Therapeutic Targets. Arterioscler THromb Vasc Biol. 2015;35(Suppl. 1):Abstract 27. 5 pages.
Raillard et al., Targeting sites within HIV-1 cDNA with a DNA-cleaving ribozyme. Biochemistry. Sep. 10, 1996;35(36):11693-701. doi: 10.1021/bi960845g.
Raina et al., PROTAC-induced BET protein degradation as a therapy for castration-resistant prostate cancer. Proc Natl Acad Sci U S A. Jun. 28, 2016;113(26):7124-9. doi: 10.1073/pnas.1521738113. Epub Jun. 6, 2016.
Rakonjac et al., Roles of PIII in filamentous phage assembly. J Mol Biol. 1998; 282(1)25-41.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Ramamurthy et al., Identification of immunogenic B-cell epitope peptides of rubella virus E1 glycoprotein towards development of highly specific immunoassays and/or vaccine. Conference Abstract. 2019.
Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.
Ramirez et al., Unexpected failure rates for modular assembly of engineered zinc fingers. Nat Methods. May 2008;5(5):374-5. Doi: 10.1038/nmeth0508-374.
Ran et al., Double Nicking by RNA-guided CRISPR Cas9 for Enhanced Genome Editing Specificity. Cell. Sep. 12, 2013;154(6):1380-9. doi: 10.1016/j.cell.2013.08.021. Epub Aug. 29, 2013.
Ran et al., Genome engineering using the CRISPR-Cas9 system. Nat Protoc. Nov. 2013;8(11):2281-308. doi: 10.1038/nprot.2013.143. Epub Oct. 24, 2013.
Ran et al., In vivo genome editing using *Staphylococcus aureus* Cas9. Nature. Apr. 9, 2015;520(7546):186-91. doi: 10.1038/nature14299. Epub Apr. 1, 2015.
Ranzau et al., Genome, Epigenome, and Transcriptome Editing via Chemical Modification of Nucleobases in Living Cells. Biochemistry. Feb. 5, 2019;58(5):330-335. doi: 10.1021/acs.biochem.8b00958. Epub Dec. 12, 2018.
Rashel et al., A novel site-specific recombination system derived from bacteriophage phiMR11. Biochem Biophys Res Commun. Apr. 4, 2008;368(2):192-8. doi: 10.1016/j.bbrc.2008.01.045. Epub Jan. 22, 2008.
Rasila et al., Critical evaluation of random mutagenesis by error-prone polymerase chain reaction protocols, *Escherichia coli* mutator strain, and hydroxylamine treatment. Anal Biochem. May 1, 2009;388(1):71-80. doi: 10.1016/j.ab.2009.02.008. Epub Feb. 10, 2009.
Raskin et al., Substitution of a single bacteriophage T3 residue in bacteriophage T7 RNA polymerase at position 748 results in a switch in promoter specificity. J Mol Biol. Nov. 20, 1992;228(2):506-15.
Raskin et al., T7 RNA polymerase mutants with altered promoter specificities. Proc Natl Acad Sci U S A. Apr. 15, 1993;90(8):3147-51.
Rath et al., Fidelity of end joining in mammalian episomes and the impact of Metnase on joint processing. BMC Mol Biol. Mar. 22, 2014;15:6. doi: 10.1186/1471-2199-15-6.
Rauch et al., Programmable RNA Binding Proteins for Imaging and Therapeutics. Biochemistry. Jan. 30, 2018;57(4):363-364. doi: 10.1021/acs.biochem.7b01101. Epub Nov. 17, 2017.
Ravishankar et al., X-ray analysis of a complex of *Escherichia coli* uracil DNA glycosylase (EcUDG) with a proteinaceous inhibitor. The structure elucidation of a prokaryotic UDG. Nuclei Acids Res. 26 (21): 4880-4887 (1998).
Ray et al., A compendium of RNA-binding motifs for decoding gene regulation. Nature. Jul. 11, 2013;499(7457):172-7. doi: 10.1038/nature12311.
Ray et al., Homologous recombination: ends as the means. Trends Plant Sci. Oct. 2002;7(10):435-40.
Rebar et al., Phage display methods for selecting zinc finger proteins with novel DNA-binding specificities. Methods Enzymol. 1996;267:129-49.
Rebuzzini et al., New mammalian cellular systems to study mutations introduced at the break site by non-homologous end-joining. DNA Repair (Amst). May 2, 2005;4(5):546-55.
Rees et al., Analysis and minimization of cellular RNA editing by DNA adenine base editors. Sci Adv. May 8, 2019;5(5):eaax5717. doi: 10.1126/sciadv.aax5717.
Rees et al., Base editing: precision chemistry on the genome and transcriptome of living cells. Nat Rev Genet. Dec. 2018;19(12):770-788. doi: 10.1038/s41576-018-0059-1.
Rees et al., Development of hRad51-Cas9 nickase fusions that mediate HDR without double-stranded breaks. Nat Commun. May 17, 2019;10(1):2212. doi: 10.1038/s41467-019-09983-4.
Rees et al., Improving the DNA specificity and applicability of base editing through protein engineering and protein delivery. Nat Commun. Jun. 6, 2017;8:15790. doi: 10.1038/ncomms15790.
Relph et al., Recent developments and current status of gene therapy using viral vectors in the United Kingdom. BMJ. 2004;329(7470):839-842. doi:10.1136/bmj.329.7470.839.
Remy et al., Gene transfer with a series of lipophilic DNA-binding molecules. Bioconjug Chem. Nov.-Dec. 1994;5(6):647-54. doi: 10.1021/bc00030a021.
Ren et al., In-line Alignment and $Mg^2$? Coordination at the Cleavage Site of the env22 Twister Ribozyme. Nat Commun. Nov. 20, 2014;5:5534. doi: 10.1038/ncomms6534.
Ren et al., Pistol Ribozyme Adopts a Pseudoknot Fold Facilitating Site-Specific In-Line Cleavage. Nat Chem Biol. Sep. 2016;12(9):702-8. doi: 10.1038/nchembio.2125. Epub Jul. 11, 2016.
Reynaud et al., What role for AID: mutator, or assembler of the immunoglobulin mutasome? Nat Immunol. Jul. 2003;4(7):631-8.
Reyon et al., FLASH assembly of TALENs for high-throughput genome editing. Nat Biotechnol. May 2012;30(5):460-5. doi: 10.1038/nbt.2170.
Ribeiro et al., Protein Engineering Strategies to Expand CRISPR-Cas9 Applications. Int J Genomics. Aug. 2, 2018;2018:1652567. doi: 10.1155/2018/1652567.
Richardson et al., CRISPR-Cas9 genome editing in human cells occurs via the Fanconi anemia pathway. Nat Genet. Aug. 2018;50(8):1132-1139. doi: 10.1038/s41588-018-0174-0. Epub Jul. 27, 2018.
Richardson et al., Enhancing homology-directed genome editing by catalytically active and inactive CRISPR-Cas9 using asymmetric donor DNA. Nat Biotechnol. Mar. 2016;34(3):339-44. doi: 10.1038/nbt.3481. Epub Jan. 20, 2016.
Richardson et al., Frequent chromosomal translocations induced by DNA double-strand breaks. Nature. Jun. 8, 2000;405(6787):697-700. doi: 10.1038/35015097.
Richter et al., Function and regulation of clustered regularly interspaced short palindromic repeats (CRISPR) / CRISPR associated (Cas) systems. Viruses. Oct. 19, 2012;4(10):2291-311. doi: 10.3390/v4102291.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020.
Riechmann et al., The C-terminal domain of To1A is the coreceptor for filamentous phage infection of *E. coli*. Cell. 1997; 90(2):351-60. PMID:9244308.

(56) References Cited

OTHER PUBLICATIONS

Ringrose et al., The Kw recombinase, an integrase from Kluyveromyces waltii. Eur J Biochem. Sep. 15, 1997;248(3):903-12. doi: 10.1111/j.1432-1033.1997.00903.x.
Risso et al., Hyperstability and substrate promiscuity in laboratory resurrections of Precambrian ?-lactamases. J Am Chem Soc. Feb. 27, 2013;135(8):2899-902. doi: 10.1021/ja311630a. Epub Feb. 14, 2013.
Ritchie et al., limma powers differential expression analyses for RNA-sequencing and microarray studies. Nucleic Acids Res. Apr. 20, 2015;43(7):e47. doi: 10.1093/nar/gkv007. Epub Jan. 20, 2015.
Robertson et al., DNA repair in mammalian cells: Base excision repair: the long and short of it. Cell Mol Life Sci. Mar. 2009;66(6):981-93. doi: 10.1007/s00018-009-8736-z.
Robertson et al., Selection in vitro of an RNA enzyme that specifically cleaves single-stranded DNA. Nature. Mar. 29, 1990;344(6265):467-8. doi: 10.1038/344467a0.
Robinson et al., The protein tyrosine kinase family of the human genome. Oncogene. Nov. 20, 2000;19(49):5548-57. doi: 10.1038/sj.onc.1203957.
Rogozin et al., Evolution and diversification of lamprey antigen receptors: evidence for involvement of an AID-APOBEC family cytosine deaminase. Nat Immunol. Jun. 2007;8(6):647-56. doi: 10.1038/ni1463. Epub Apr. 29, 2007.
Rong et al., Homologous recombination in human embryonic stem cells using CRISPR/Cas9 nickase and a long DNA donor template. Protein Cell. Apr. 2014;5(4):258-60. doi: 10.1007/s13238-014-0032-5.
Rongrong et al., Effect of deletion mutation on the recombination activity of Cre recombinase. Acta Biochim Pol. 2005;52(2):541-4. Epub May 15, 2005.
Roth et al., A widespread self-cleaving ribozyme class is revealed by bioinformatics. Nat Chem Biol. Jan. 2014;10(1):56-60. doi: 10.1038/nchembio.1386. Epub Nov. 17, 2013.
Roth et al., Purification and characterization of murine retroviral reverse transcriptase expressed in *Escherichia coli*. J Biol Chem. Aug. 5, 1985;260(16):9326-35.
Rouet et al., Expression of a site-specific endonuclease stimulates homologous recombination in mammalian cells. Proc Natl Acad Sci U S A. Jun. 21, 1994;91(13):6064-8. doi: 10.1073/pnas.91.13.6064.
Rouet et al., Introduction of double-strand breaks into the genome of mouse cells by expression of a rare-cutting endonuclease. Mol Cell Biol. Dec. 1994;14(12):8096-106. doi: 10.1128/mcb.14.12.8096.
Rouet et al., Receptor-Mediated Delivery of CRISPR-Cas9 Endonuclease for Cell-Type-Specific Gene Editing. J Am Chem Soc. May 30, 2018;140(21):6596-6603. doi: 10.1021/jacs.8b01551. Epub May 18, 2018.
Roundtree et al., YTHDC1 mediates nuclear export of N6-methyladenosine methylated mRNAs. Elife. Oct. 6, 2017;6:e31311. doi: 10.7554/eLife.31311.
Rowland et al., Regulatory mutations in Sin recombinase support a structure-based model of the synaptosome. Mol Microbiol. Oct. 2009;74(2):282-98. doi: 10.1111/j.1365-2958.2009.06756.x. Epub Jun. 8, 2009.
Rowland et al., Sin recombinase from *Staphylococcus aureus*: synaptic complex architecture and transposon targeting. Mol Microbiol. May 2002;44(3):607-19. doi: 10.1046/j.1365-2958.2002.02897.x.
Rowley, Chromosome translocations: dangerous liaisons revisited. Nat Rev Cancer. Dec. 2001;1(3):245-50. doi: 10.1038/35106108.
Rubio et al., An adenosine-to-inosine tRNA-editing enzyme that can perform C-to-U deamination of DNA. Proc Natl Acad Sci U S A. May 8, 2007;104(19):7821-6. doi: 10.1073/pnas.0702394104. Epub May 1, 2007. PMID: 17483465; PMCID: PMC1876531.
Rubio et al., Transfer RNA travels from the cytoplasm to organelles. Wiley Interdiscip Rev RNA. Nov.-Dec. 2011;2(6):802-17. doi: 10.1002/wrna.93. Epub Jul. 11, 2011.
Rudolph et al., Synthetic riboswitches for the conditional control of gene expression in Streptomyces coelicolor. Microbiology. Jul. 2013;159(Pt 7):1416-22. doi: 10.1099/mic.0.067322-0. Epub May 15, 2013.
Rutherford et al., Attachment site recognition and regulation of directionality by the serine integrases. Nucleic Acids Res. Sep. 2013;41(17):8341-56. doi: 10.1093/nar/gkt580. Epub Jul. 2, 2013.
Ryu et al., Adenine base editing in mouse embryos and an adult mouse model of Duchenne muscular dystrophy. Nat Biotechnol. Jul. 2018;36(6):536-539. doi: 10.1038/nbt.4148. Epub Apr. 27, 2018.
Rüfer et al., Non-contact positions impose site selectivity on Cre recombinase. Nucleic Acids Res. Jul. 1, 2002;30(13):2764-71. doi: 10.1093/nar/gkf399.
Sadelain et al., Safe harbours for the integration of new DNA in the human genome. Nat Rev Cancer. Dec. 1, 2011;12(1):51-8. doi: 10.1038/nrc3179.
Sadowski, The Flp recombinase of the 2-microns plasmid of *Saccharomyces cerevisiae*. Prog Nucleic Acid Res Mol Biol. 1995;51:53-91.
Safari et al., CRISPR Cpf1 proteins: structure, function and implications for genome editing. Cell Biosci. May 9, 2019;9:36. doi: 10.1186/s13578-019-0298-7.
Sage et al., Proliferation of functional hair cells in vivo in the absence of the retinoblastoma protein. Science. Feb. 18, 2005;307(5712):1114-8. Epub Jan. 13, 2005.
Saha et al., The NIH Somatic Cell Genome Editing program. Nature. Apr. 2021;592(7853):195-204. doi: 10.1038/s41586-021-03191-1. Epub Apr. 7, 2021.
Sakuma et al., MMEJ-assisted gene knock-in using TALENs and CRISPR-Cas9 with the PITCh systems. Nat Protoc. Jan. 2016;11(1):118-33. doi: 10.1038/nprot.2015.140. Epub Dec. 17, 2015.
Sale et al., Y-family DNA polymerases and their role in tolerance of cellular DNA damage. Nat Rev Mol Cell Biol. Feb. 23, 2012;13(3):141-52. doi: 10.1038/nrm3289.
Saleh-Gohari et al., Conservative homologous recombination preferentially repairs DNA double-strand breaks in the S phase of the cell cycle in human cells. Nucleic Acids Res. Jul. 13, 2004;32(12):3683-8. Print 2004.
Samal et al., Cationic polymers and their therapeutic potential. Chem Soc Rev. Nov. 7, 2012;41(21):7147-94. doi: 10.1039/c2cs35094g. Epub Aug. 10, 2012.
Samanta et al., A reverse transcriptase ribozyme. Elife. Sep. 26, 2017;6:e31153. doi: 10.7554/eLife.31153.
Samulski et al., Helper-free stocks of recombinant adeno-associated viruses: normal integration does not require viral gene expression. J Virol. Sep. 1989;63(9):3822-8. doi: 10.1128/JVI.63.9.3822-3828.1989.
San Filippo et al., Mechanism of eukaryotic homologous recombination. Annu Rev Biochem. 2008;77:229-57. doi: 10.1146/annurev.biochem.77.061306.125255.
Sander et al., CRISPR-Cas systems for editing, regulating and targeting genomes. Nat Biotechnol. Apr. 2014;32(4):347-55. doi: 10.1038/nbt.2842. Epub Mar. 2, 2014.
Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.
Sander et al., Targeted gene disruption in somatic zebrafish cells using engineered TALENs. Nat Biotechnol. Aug. 5, 2011;29(8):697-8. doi: 10.1038/nbt.1934.
Sang et al., A unique uracil-DNA binding protein of the uracil DNA glycosylase superfamily. Nucleic Acids Res. Sep. 30, 2015;43(17):8452-63. doi: 10.1093/nar/gkv854. Epub Aug. 24, 2015.
Sang, Prospects for transgenesis in the chick. Mech Dev. Sep. 2004;121(9):1179-86.
Sanjana et al., A transcription activator-like effector toolbox for genome engineering. Nat Protoc. Jan. 5, 2012;7(1):171-92. doi: 10.1038/nprot.2011.431.
Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

(56) References Cited

OTHER PUBLICATIONS

Santoro et al., Directed evolution of the site specificity of Cre recombinase. Proc Natl Acad Sci U S A. Apr. 2, 2002;99(7):4185-90. Epub Mar. 19, 2002.
Saparbaev et al., Excision of hypoxanthine from DNA containing dIMP residues by the *Escherichia coli*, yeast, rat, and human alkylpurine DNA glycosylases. Proc Natl Acad Sci U S A. Jun. 21, 1994;91(13):5873-7. doi: 10.1073/pnas.91.13.5873.
Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.
Sapunar et al., Dorsal root ganglion—a potential new therapeutic target for neuropathic pain. J Pain Res. 2012;5:31-8. doi: 10.2147/JPR.S26603. Epub Feb. 16, 2012.
Saraconi et al., The RNA editing enzyme APOBEC1 induces somatic mutations and a compatible mutational signature is present in esophageal adenocarcinomas. Genome Biol. Jul. 31, 2014;15(7):417. doi: 10.1186/s13059-014-0417-z.
Sarkar et al., HIV-1 proviral DNA excision using an evolved recombinase. Science. Jun. 29, 2007;316(5833):1912-5. doi: 10.1126/science.1141453.
Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.
Sasidharan et al., The selection of acceptable protein mutations. PNAS; Jun. 12, 2007;104(24):10080-5. www.pnas.org/cgi/doi/10.1073.pnas.0703737104.
Satomura et al., Precise genome-wide base editing by the CRISPR Nickase system in yeast. Sci Rep. May 18, 2017;7(1):2095. doi: 10.1038/s41598-017-02013-7.
Saudek et al., A preliminary trial of the programmable implantable medication system for insulin delivery. Engl J Med. Aug. 31, 1989;321(9):574-9.
Sauer et al., DNA recombination with a heterospecific Cre homolog identified from comparison of the pac-c1 regions of P1-related phages. Nucleic Acids Res. Nov. 18, 2004;32(20):6086-95. doi: 10.1093/nar/gkh941.
Savic et al., Covalent linkage of the DNA repair template to the CRISPR-Cas9 nuclease enhances homology-directed repair. Elife. May 29, 2018;7:e33761. doi: 10.7554/eLife.33761.
Saville et al., A site-specific self-cleavage reaction performed by a novel RNA in Neurospora mitochondria. Cell. May 18, 1990;61(4):685-96. doi: 10.1016/0092-8674(90)90480-3.
Savva et al., The structural basis of specific base-excision repair by uracil-DNA glycosylase. Nature. Feb. 9, 1995;373(6514):487-93. doi: 10.1038/373487a0.
Schaaper et al., Base selection, proofreading, and mismatch repair during DNA replication in *Escherichia coli*. J Biol Chem. Nov. 15, 1993;268(32):23762-5.
Schaaper et al., Spectra of spontaneous mutations in *Escherichia coli* strains defective in mismatch correction: the nature of in vivo DNA replication errors. Proc Natl Acad Sci U S A. Sep. 1987;84(17):6220-4.
Schaefer et al., Understanding RNA modifications: the promises and technological bottlenecks of the 'epitranscriptome'. Open Biol. May 2017;7(5):170077. doi: 10.1098/rsob.170077.
Schechner et al., Multiplexable, locus-specific targeting of long RNAs with CRISPR-Display. Nat Methods. Jul. 2015; 12(7):664-70. doi: 10.1038/nmeth.3433. Epub Jun. 1, 2015. Author manuscript entitled CRISPR Display: A modular method for locus-specific targeting of long noncoding RNAs and synthetic RNA devices in vivo.
Schek et al., Definition of the upstream efficiency element of the simian virus 40 late polyadenylation signal by using in vitro analyses. Mol Cell Biol. Dec. 1992;12(12):5386-93. doi: 10.1128/mcb.12.12.5386.
Schenk et al., MPDU1 mutations underlie a novel human congenital disorder of glycosylation, designated type If. J Clin Invest. Dec. 2001;108(11):1687-95. doi: 10.1172/JCI13419.
Schlacher et al., Double-strand break repair-independent role for BRCA2 in blocking stalled replication fork degradation by MRE11. Cell. May 13, 2011;145(4):529-42. doi: 10.1016/j.cell.2011.03.041. Erratum in: Cell. Jun. 10, 2011;145(6):993.
Schmitz et al., Behavioral abnormalities in prion protein knockout mice and the potential relevance of PrP(C) for the cytoskeleton. Prion. 2014;8(6):381-6. doi: 10.4161/19336896.2014.983746.
Schriefer et al., Low pressure DNA shearing: a method for random DNA sequence analysis. Nucleic Acids Res. Dec. 25, 1990;18(24):7455-6.
Schultz et al., Expression and secretion in yeast of a 400-kDa envelope glycoprotein derived from Epstein-Barr virus. Gene. 1987;54(1):113-23. doi: 10.1016/0378-1119(87)90353-2.
Schultz et al., Oligo-2'-fluoro-2'-deoxynucleotide N3' -->P5' phosphoramidates: synthesis and properties. Nucleic Acids Res. Aug. 1, 1996;24(15):2966-73.
Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.
Schwartz et al., Post-translational enzyme activation in an animal via optimized conditional protein splicing. Nat Chem Biol. Jan. 2007;3(1):50-4. Epub Nov. 26, 2006.
Schwarze et al., In vivo protein transduction: delivery of a biologically active protein into the mouse. Science. Sep. 3, 1999;285(5433):1569-72.
Schöller et al., Interactions, localization, and phosphorylation of the m6A generating METTL3-METTL14-WTAP complex. RNA. Apr. 2018;24(4):499-512. doi: 10.1261/rna.064063.117. Epub Jan. 18, 2018.
Sclimenti et al., Directed evolution of a recombinase for improved genomic integration at a native human sequence. Nucleic Acids Res. Dec. 15, 2001;29(24):5044-51.
Score Results for Luetticken et al., Complete genome sequence of a *Streptococcus dysgalactiae* subsp. RT equisimilis strain possessing Lancefield's group A antigen. RL Submitted to the EMBL/GenBank/DDBJ databases. May 2012. 3 pages.
Score Results for Okumura et al., Evolutionary paths of streptococcal and staphylococcal superantigens. RL BMC Genomics. 2012;13:404-404. 3 pages.
Score Results for SHIMOMURA et al., Complete Genome Sequencing and Analysis of a Lancefield Group G RT *Streptococcus dysagalactiae* Subsp. Equisimilis Strain Causing Streptococcal RT Toxic Shock Syndrome (STSS). RL BMC Genomics. 2011;12:17-17. 3 pages.
Scott et al., Production of cyclic peptides and proteins in vivo. Proc Natl Acad Sci U S A. Nov. 23, 1999;96(24):13638-43. doi: 10.1073/pnas.96.24.13638.
Sebastián-Martín et al., Transcriptional inaccuracy threshold attenuates differences in RNA-dependent DNA synthesis fidelity between retroviral reverse transcriptases. Sci Rep. Jan. 12, 2018;8(1):627. doi: 10.1038/s41598-017-18974-8.
Seed, An LFA-3 cDNA encodes a phospholipid-linked membrane protein homologous to its receptor CD2. Nature. Oct. 29-Nov. 4, 1987;329(6142):840-2. doi: 10.1038/329840a0.
Sefton et al., Implantable pumps. Crit Rev Biomed Eng. 1987;14(3):201-40.
Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.
Sells et al., Delivery of protein into cells using polycationic liposomes. Biotechniques. Jul. 1995;19(1):72-6, 78.
Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.
Semple et al., Rational design of cationic lipids for siRNA delivery. Nat Biotechnol. Feb. 2010;28(2):172-6. doi: 10.1038/nbt.1602. Epub Jan. 17, 2010.
Serganov et al., Coenzyme recognition and gene regulation by a flavin mononucleotide riboswitch. Nature. Mar. 12, 2009;458(7235):233-7. doi: 10.1038/nature07642. Epub Jan. 25, 2009.

(56) References Cited

OTHER PUBLICATIONS

Serganov et al., Structural basis for discriminative regulation of gene expression by adenine- and guanine-sensing mRNAs. Chem Biol. Dec. 2004;11(12):1729-41.
Serganov et al., Structural basis for gene regulation by a thiamine pyrophosphate-sensing riboswitch. Nature. Jun. 29, 2006;441(7097):1167-71. Epub May 21, 2006.
Seripa et al., The missing ApoE allele. Ann Hum Genet. Jul. 2007;71(Pt 4):496-500. Epub Jan. 22, 2007.
Serrano-Heras et al., Protein p56 from the Bacillus subtilis phage phi29 inhibits DNA-binding ability of uracil-DNA glycosylase. Nucleic Acids Res. 2007;35(16):5393-401. Epub Aug. 13, 2007.
Setten et al., The current state and future directions of RNAi-based therapeutics. Nat Rev Drug Discov. Jun. 2019; 18(6):421-446. doi: 10.1038/s41573-019-0017-4.
Severinov et al., Expressed protein ligation, a novel method for studying protein-protein interactions in transcription. J Biol Chem. Jun. 26, 1998;273(26):16205-9. doi: 10.1074/jbc.273.26.16205.
Sha et al., Monobodies and other synthetic binding proteins for expanding protein science. Protein Sci. May 2017;26(5):910-924. doi: 10.1002/pro.3148. Epub Mar. 24, 2017.
Shah et al., Inteins: nature's gift to protein chemists. Chem Sci. 2014;5(1):446-461.
Shah et al., Kinetic control of one-pot trans-splicing reactions by using a wild-type and designed split intein. Angew Chem Int Ed Engl. Jul. 11, 2011;50(29):6511-5. doi: 10.1002/anie.201102909. Epub Jun. 8, 2011.
Shah et al., Protospacer recognition motifs: mixed identities and functional diversity. RNA Biol. May 2013;10(5):891-9. doi: 10.4161/rna.23764. Epub Feb. 12, 2013.
Shah et al., Target-specific variants of Flp recombinase mediate genome engineering reactions in mammalian cells. FEBS J. Sep. 2015;282(17):3323-33. doi: 10.1111/febs.13345. Epub Jul. 1, 2015.
Shaikh et al., Chimeras of the Flp and Cre recombinases: tests of the mode of cleavage by Flp and Cre. J Mol Biol. Sep. 8, 2000;302(1):27-48.
Shalem et al., Genome-scale CRISPR-Cas9 knockout screening in human cells. Science. Jan. 3, 2014;343(6166):84-7. doi: 10.1126/science.1247005. Epub Dec. 12, 2013.
Shalem et al., High-throughput functional genomics using CRISPR-Cas9. Nat Rev Genet. May 2015;16(5):299-311. doi: 10.1038/nrg3899. Epub Apr. 9, 2015.
Sharbeen et al., Ectopic restriction of DNA repair reveals that UNG2 excises AID-induced uracils predominantly or exclusively during G1 phase. J Exp Med. May 7, 2012;209(5):965-74. doi: 10.1084/jem.20112379. Epub Apr. 23, 2012.
Sharer et al., The ARF-like 2 (ARL2)-binding protein, BART. Purification, cloning, and initial characterization. J Biol Chem. Sep. 24, 1999;274(39):27553-61. doi: 10.1074/jbc.274.39.27553.
Sharma et al., Efficient introduction of aryl bromide functionality into proteins in vivo. FEBS Lett. Feb. 4, 2000;467(1):37-40.
Sharma et al., Identification of novel methyltransferases, Bmt5 and Bmt6, responsible for the m3U methylations of 25S rRNA in *Saccharomyces cerevisiae*. Nucleic Acids Res. Mar. 2014;42(5):3246-60. doi: 10.1093/nar/gkt1281. Epub Dec. 11, 2013.
Sharon et al., Functional Genetic Variants Revealed by Massively Parallel Precise Genome Editing. Cell. Oct. 4, 2018;175(2):544-557.e16. doi: 10.1016/j.cell.2018.08.057. Epub Sep. 20, 2018.
Shaw et al., Implications of human genome architecture for rearrangement-based disorders: the genomic basis of disease. Hum Mol Genet. Apr. 1, 2004;13 Spec No. 1:R57-64. doi: 10.1093/hmg/ddh073. Epub Feb. 5, 2004.
Shcherbakova et al., Near-infrared fluorescent proteins for multicolor in vivo imaging. Nat Methods. Aug. 2013;10(8):751-4. doi: 10.1038/nmeth.2521. Epub Jun. 16, 2013.
Shechner et al., Multiplexable, locus-specific targeting of long RNAs with CRISPR-Display. Nat Methods. Jul. 2015; 12(7):664-70. doi: 10.1038/nmeth.3433. Epub Jun. 1, 2015.
Shee et al., Engineered proteins detect spontaneous DNA breakage in human and bacterial cells. Elife. Oct. 29, 2013;2:e01222. doi: 10.7554/eLife.01222.
Shen et al., Efficient genome modification by CRISPR-Cas9 nickase with minimal off-target effects. Nat Methods. Apr. 2014;11(4):399-402. doi: 10.1038/nmeth.2857. Epub Mar. 2, 2014.
Shen et al., Herpes simplex virus 1 (HSV-1) for cancer treatment. Cancer Gene Ther. Nov. 2006;13(11):975-92. doi: 10.1038/sj.cgt.7700946. Epub Apr. 7, 2006.
Shen et al., Predictable and precise template-free CRISPR editing of pathogenic variants. Nature. Nov. 2018;563(7733):646-651. doi: 10.1038/s41586-018-0686-x. Epub Nov. 7, 2018.
Shen, Data processing, Modeling and Analysis scripts for CRISPR-inDelphi. GitHub—maxwshen/indelphi-dataprocessinganalysis at 6b68e3cec73c9358fef6e5f178a935f3c2a4118f. Apr. 10, 2018. Retrieved online via https://github.com/maxwshen/indelphi-sataprocessinganalysis/tree/6b68e3cec73c9358fef6e5f178a935f3c2a4118f Last retrieved on Jul. 26, 2021. 2 pages.
Sheridan, First CRISPR-Cas patent opens race to stake out intellectual property. Nat Biotechnol. 2014;32(7):599-601.
Sheridan, Gene therapy finds its niche. Nat Biotechnol. Feb. 2011;29(2):121-8. doi: 10.1038/nbt.1769.
Sherwood et al., Discovery of directional and nondirectional pioneer transcription factors by modeling DNase profile magnitude and shape. Nat Biotechnol. Feb. 2014;32(2):171-178. doi: 10.1038/nbt.2798. Epub Jan. 19, 2014.
Shi et al., Structural basis for targeted DNA cytosine deamination and mutagenesis by APOBEC3A and APOBEC3B. Nat Struct Mol Biol. Feb. 2017;24(2):131-139. doi: 10.1038/nsmb.3344. Epub Dec. 19, 2016.
Shi et al., YTHDF3 facilitates translation and decay of N6-methyladenosine-modified RNA. Cell Res. Mar. 2017;27(3):315-328. doi: 10.1038/cr.2017.15. Epub Jan. 20, 2017.
Shimantani et al., Targeted base editing in rice and tomato using a CRISPR-Cas9 cytidine deaminase fusion. Nat Biotechnol. May 2017;35(5):441-443. doi: 10.1038/nbt.3833. Epub Mar. 27, 2017.
Shimojima et al., Spinocerebellar ataxias type 27 derived from a disruption of the fibroblast growth factor 14 gene with mimicking phenotype of paroxysmal non-kinesigenic dyskinesia. Brain Dev. Mar. 2012;34(3):230-3. doi: 10.1016/j.braindev.2011.04.014. Epub May 19, 2011.
Shin et al., CRISPR/Cas9 targeting events cause complex deletions and insertions at 17 sites in the mouse genome. Nat Commun. May 31, 2017;8:15464. doi: 10.1038/ncomms15464.
Shindo et al., A Comparison of Two Single-Stranded DNA Binding Models by Mutational Analysis of APOBEC3G. Biology (Basel). Aug. 2, 2012;1(2):260-76. doi: 10.3390/biology1020260.
Shingledecker et al., Molecular dissection of the *Mycobacterium tuberculosis* RecA intein: design of a minimal intein and of a trans-splicing system involving two intein fragments. Gene. Jan. 30, 1998;207(2):187-95. doi: 10.1016/s0378-1119(97)00624-0.
Shmakov et al., Discovery and Functional Characterization of Diverse Class 2 CRISPR Cas Systems. Molecular Cell Nov. 2015;60(3):385-97.
Shmakov et al., Diversity and evolution of class 2 CRISPR-Cas systems. Nat Rev Microbiol. Mar. 2017;15(3):169-182. doi: 10.1038/nrmicro.2016.184. Epub Jan. 23, 2017.
Shultz et al., A genome-wide analysis of FRT-like sequences in the human genome. PLoS One. Mar. 23, 2011;6(3):e18077. doi: 10.1371/journal.pone.0018077.
Siebert et al., An improved PCR method for walking in uncloned genomic DNA. Nucleic Acids Res. Mar. 25, 1995;23(6):1087-8.
Silas et al., Direct CRISPR spacer acquisition from RNA by a natural reverse transcriptase-Cas1 fusion protein. Science. Feb. 26, 2016;351(6276):aad4234. doi: 10.1126/science.aad4234.
Silva et al., Selective disruption of the DNA polymerase III α-ß complex by the umuD gene products. Nucleic Acids Res. Jul. 2012;40(12):5511-22. doi: 10.1093/nar/gks229. Epub Mar. 9, 2012.
Simonelli et al., Base excision repair intermediates are mutagenic in mammalian cells. Nucleic Acids Res. Aug. 2, 2005;33(14):4404-11. Print 2005.

(56) References Cited

OTHER PUBLICATIONS

Singh et al., Cross-talk between diverse serine integrases. J Mol Biol. Jan. 23, 2014;426(2):318-31. doi: 10.1016/j.jmb.2013.10.013. Epub Oct. 22, 2013.
Singh et al., Real-time observation of DNA recognition and rejection by the RNA-guided endonuclease Cas9. Nat Commun. Sep. 14, 2016;7:12778. doi: 10.1038/ncomms12778.
Singh et al., Real-time observation of DNA target interrogation and product release by the RNA-guided endonuclease CRISPR Cpf1 (Cas12a). Proc Natl Acad Sci U S A. May 22, 2018;115(21):5444-5449. doi: 10.1073/pnas.1718686115. Epub May 7, 2018.
Sirk et al., Expanding the zinc-finger recombinase repertoire: directed evolution and mutational analysis of serine recombinase specificity determinants. Nucleic Acids Res. Apr. 2014;42(7):4755-66. doi: 10.1093/nar/gkt1389. Epub Jan. 21, 2014.
Siu et al., Riboregulated toehold-gated gRNA for programmable CRISPR-Cas9 function. Nat Chem Biol. Mar. 2019;15(3):217-220. doi: 10.1038/s41589-018-0186-1. Epub Dec. 10, 2018.
Sivalingam et al., Biosafety assessment of site-directed transgene integration in human umbilical cord-lining cells. Mol Ther. Jul. 2010;18(7):1346-56. doi: 10.1038/mt.2010.61. Epub Apr. 27, 2010.
Sjoblom et al., The consensus coding sequences of human breast and colorectal cancers. Science. Oct. 13, 2006;314(5797):268-74. Epub Sep. 7, 2006.
Skretas et al., Regulation of protein activity with small-molecule-controlled inteins. Protein Sci. Feb. 2005;14(2):523-32. Epub Jan. 4, 2005.
Slaymaker et al., Rationally engineered Cas9 nucleases with improved specificity. Science. Jan. 1, 2016;351(6268):84-8. doi: 10.1126/science.aad5227. Epub Dec. 1, 2015.
Sledz et al., Structural insights into the molecular mechanism of the m(6)A writer complex. Elife. Sep. 14, 2016;5:e18434. doi: 10.7554/eLife.18434.
Slupphaug et al., A nucleotide-flipping mechanism from the structure of human uracil-DNA glycosylase bound to DNA. Nature. Nov. 7, 1996;384(6604):87-92. doi: 10.1038/384087a0.
Smargon et al., Cas13b Is a Type VI-B CRISPR-Associated RNA-Guided RNase Differentially Regulated by Accessory Proteins Csx27 and Csx28. Mol Cell. Feb. 16, 2017;65(4):618-630.e7. doi: 10.1016/j.molcel.2016.12.023. Epub Jan. 5, 2017.
Smith et al., Diversity in the serine recombinases. Mol Microbiol. Apr. 2002;44(2):299-307. Review.
Smith et al., Expression of a dominant negative retinoic acid receptor γ in Xenopus embryos leads to partial resistance to retinoic acid. Roux Arch Dev Biol. Mar. 1994;203(5):254-265. doi: 10.1007/BF00360521.
Smith et al., Herpesvirus transport to the nervous system and back again. Annu Rev Microbiol. 2012;66:153-76. doi: 10.1146/annurev-micro-092611-150051. Epub Jun. 15, 2012.
Smith et al., Production of human beta interferon in insect cells infected with a baculovirus expression vector. Mol Cell Biol. Dec. 1983;3(12):2156-65. doi: 10.1128/mcb.3.12.2156.
Smith et al., Single-step purification of polypeptides expressed in *Escherichia coli* as fusions with glutathione S-transferase. Gene. Jul. 15, 1988;67(1):31-40. doi: 10.1016/0378-1119(88)90005-4.
Smith, Filamentous fusion phage: novel expression vectors that display cloned antigens on the virion surface. Science. Jun. 14, 1985;228(4705):1315-7.
Smith, Phage-encoded Serine Integrases and Other Large Serine Recombinases. Microbiol Spectr. Aug. 2015;3(4). doi: 10.1128/microbiolspec.MDNA3-0059-2014.
Somanathan et al., AAV vectors expressing LDLR gain-of-function variants demonstrate increased efficacy in mouse models of familial hypercholesterolemia. Circ Res. Aug. 29, 2014;115(6):591-9. doi: 10.1161/CIRCRESAHA.115.304008. Epub Jul. 14, 2014.
Sommerfelt et al., Receptor interference groups of 20 retroviruses plating on human cells. Virology. May 1990;176(1):58-69. doi: 10.1016/0042-6822(90)90230-o.
Song et al., Adenine base editing in an adult mouse model of tyrosinaemia. Nat Biomed Eng. Jan. 2020;4(1):125-130. doi: 10.1038/s41551-019-0357-8. Epub Feb. 25, 2019.
Song et al., Delivery of CRISPR/Cas systems for cancer gene therapy and immunotherapy. Adv Drug Deliv Rev. Jan. 2021;168:158-180. doi: 10.1016/j.addr.2020.04.010. Epub May 1, 2020.
Song et al., RS-1 enhances CRISPR/Cas9- and TALEN-mediated knock-in efficiency. Nat Commun. Jan. 28, 2016;7:10548. doi: 10.1038/ncomms10548.
Southworth et al., Control of protein splicing by intein fragment reassembly. EMBO J. Feb. 16, 1998;17(4):918-26. doi: 10.1093/emboj/17.4.918.
Southworth et al., Purification of proteins fused to either the amino or carboxy terminus of the *Mycobacterium xenopi* gyrase A intein. Biotechniques. Jul. 1999;27(1):110-4, 116, 118-20. doi: 10.2144/99271st04.
Spencer et al., A general strategy for producing conditional alleles of Src-like tyrosine kinases. Proc Natl Acad Sci U S A. Oct. 10, 1995;92(21):9805-9. doi: 10.1073/pnas.92.21.9805.
Spencer et al., Controlling signal transduction with synthetic ligands. Science. Nov. 12, 1993;262(5136):1019-24. doi: 10.1126/science.7694365.
Spencer et al., Functional analysis of Fas signaling in vivo using synthetic inducers of dimerization. Curr Biol. Jul. 1, 1996;6(7):839-47. doi: 10.1016/s0960-9822(02)00607-3.
Srivastava et al., An inhibitor of nonhomologous end-joining abrogates double-strand break repair and impedes cancer progression. Cell. Dec. 21, 2012;151(7):1474-87. doi: 10.1016/j.cell.2012.11.054.
Stadtman, Selenocysteine. Annu Rev Biochem. 1996;65:83-100.
Stamos et al., Structure of a Thermostable Group II Intron Reverse Transcriptase with Template-Primer and Its Functional and Evolutionary Implications. Mol Cell. Dec. 7, 2017;68(5):926-939.e4. doi: 10.1016/j.molcel.2017.10.024. Epub Nov. 16, 2017.
Stark et al., ATP hydrolysis by mammalian RAD51 has a key role during homology-directed DNA repair. J Biol Chem. Jun. 7, 2002;277(23):20185-94. doi: 10.1074/jbc.M112132200. Epub Mar. 28, 2002.
Steele et al., The prion protein knockout mouse: a phenotype under challenge. Prion. Apr.-Jun. 2007;1(2):83-93. doi: 10.4161/pri.1.2.4346. Epub Apr. 25, 2007.
Steiner et al., The neurotropic herpes viruses: herpes simplex and varicella-zoster. Lancet Neurol. Nov. 2007;6(11):1015-28. doi: 10.1016/S1474-4422(07)70267-3.
Stella et al., Structure of the Cpf1 endonuclease R-loop complex after target DNA cleavage. Nature. Jun. 22, 2017;546(7659):559-563. doi: 10.1038/nature22398. Epub May 31, 2017.
Stenglein et al., APOBEC3 proteins mediate the clearance of foreign DNA from human cells. Nat Struct Mol Biol. Feb. 2010; 17(2):222-9. doi: 10.1038/nsmb.1744. Epub Jan. 10, 2010.
Stenson et al., The Human Gene Mutation Database: towards a comprehensive repository of inherited mutation data for medical research, genetic diagnosis and next-generation sequencing studies. Hum Genet. Jun. 2017;136(6):665-677. doi: 10.1007/s00439-017-1779-6. Epub Mar. 27, 2017.
Stephens et al., The landscape of cancer genes and mutational processes in breast cancer. Nature Jun. 2012;486:400-404. doi:10.1038/nature11017.
Sternberg et al., Conformational control of DNA target cleavage by CRISPR-Cas9. Nature. Nov. 5, 2015;527(7576):110-3. doi: 10.1038/nature15544. Epub Oct. 28, 2015.
Sternberg et al., DNA interrogation by the CRISPR RNA-guided endonuclease Cas9. Nature.Mar. 6, 2014;507(7490):62-7. doi: 10.1038/nature13011. Epub Jan. 29, 2014.
Sterne-Weiler et al., Exon identity crisis: disease-causing mutations that disrupt the splicing code. Genome Biol. Jan. 23, 2014;15(1):201. doi: 10.1186/gb4150.
Stevens et al., A promiscuous split intein with expanded protein engineering applications. Proc Natl Acad Sci U S A. Aug. 8, 2017;114(32):8538-8543. doi: 10.1073/pnas.1701083114. Epub Jul. 24, 2017.

(56) References Cited

OTHER PUBLICATIONS

Stevens et al., Design of a Split Intein with Exceptional Protein-Splicing Activity. J Am Chem Soc. Feb. 24, 2016;138(7):2162-5. doi: 10.1021/jacs.5b13528. Epub Feb. 8, 2016.
Stockwell et al., Probing the role of homomeric and heteromeric receptor interactions in TGF-beta signaling using small molecule dimerizers. Curr Biol. Jun. 18, 1998;8(13):761-70. doi: 10.1016/s0960-9822(98)70299-4.
Strecker et al., Engineering of CRISPR-Cas12b for human genome editing. Nat Commun. Jan. 22, 2019;10(1):212. doi: 10.1038/s41467-018-08224-4.
Strecker et al., RNA-guided DNA insertion with CRISPR-associated transposases. Science. Jul. 5, 2019;365(6448):48-53. doi: 10.1126/science.aax9181. Epub Jun. 6, 2019.
Strutt et al., RNA-dependent RNA targeting by CRISPR-Cas9. Elife. Jan. 5, 2018;7:e32724. doi: 10.7554/eLife.32724.
Su et al., Human DNA polymerase ? has reverse transcriptase activity in cellular environments. J Biol Chem. Apr. 12, 2019;294(15):6073-6081. doi: 10.1074/jbc.RA119.007925. Epub Mar. 6, 2019.
Sudarsan et al., An mRNA structure in bacteria that controls gene expression by binding lysine. Genes Dev. Nov. 1, 2003;17(21):2688-97.
Sudarsan et al., Riboswitches in eubacteria sense the second messenger cyclic di-GMP. Science. Jul. 18, 2008;321(5887):411-3. doi: 10.1126/science.1159519.
Suess et al., A theophylline responsive riboswitch based on helix slipping controls gene expression in vivo. Nucleic Acids Res. Mar. 5, 2004;32(4):1610-4.
Suh et al., Restoration of visual function in adult mice with an inherited retinal disease via adenine base editing. Nat Biomed Eng. Feb. 2021;5(2):169-178. doi: 10.1038/s41551-020-00632-6. Epub Oct. 19, 2020.
Sullenger et al., Ribozyme-mediated repair of defective mRNA by targeted, trans-splicing. Nature. Oct. 13, 1994;371(6498):619-22. doi: 10.1038/371619a0.
Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.
Sun et al., The CRISPR/Cas9 system for gene editing and its potential application in pain research. Transl Periop & Pain Med. Aug. 3, 2016;1(3):22-33.
Surun et al., High Efficiency Gene Correction in Hematopoietic Cells by Donor-Template-Free CRISPR/Cas9 Genome Editing. Mol Ther Nucleic Acids. Mar. 2, 2018;10:1-8. doi: 10.1016/j.omtn.2017.11.001. Epub Nov. 10, 2017.
Suzuki et al., Crystal structures reveal an elusive functional domain of pyrrolysyl-tRNA synthetase. Nat Chem Biol. Dec. 2017;13(12):1261-1266. doi: 10.1038/nchembio.2497. Epub Oct. 16, 2017.
Suzuki et al., In vivo genome editing via CRISPR/Cas9 mediated homology-independent targeted integration. Nature. Dec. 1, 2016;540(7631):144-149. doi: 10.1038/nature20565. Epub Nov. 16, 2016.
Suzuki et al., VCre/VloxP and SCre/SloxP: new site-specific recombination systems for genome engineering. Nucleic Acids Res. Apr. 2011;39(8):e49. doi: 10.1093/nar/gkq1280. Epub Feb. 1, 2011.
Swarts et al., Argonaute of the archaeon Pyrococcus furiosus is a DNA-guided nuclease that targets cognate DNA. Nucleic Acids Res. May 26, 2015;43(10):5120-9. doi: 10.1093/nar/gkv415. Epub Apr. 29, 2015.
Swarts et al., DNA-guided DNA interference by a prokaryotic Argonaute. Nature. Mar. 13, 2014;507(7491):258-61. doi: 10.1038/nature12971. Epub Feb. 16, 2014.
Swarts et al., The evolutionary journey of Argonaute proteins. Nat Struct Mol Biol. Sep. 2014;21(9):743-53. doi: 10.1038/nsmb.2879.
Szczepek et al., Structure-based redesign of the dimerization interface reduces the toxicity of zinc-finger nucleases. Nat Biotechnol. Jul. 2007;25(7):786-93. Epub Jul. 1, 2007.
Tabebordbar et al., In vivo gene editing in dystrophic mouse muscle and muscle stem cells. Science. Jan. 22, 2016;351(6271):407-411. doi: 10.1126/science.aad5177. Epub Dec. 31, 2015.
Tagalakis et al., Lack of RNA-DNA oligonucleotide (chimeraplast) mutagenic activity in mouse embryos. Mol Reprod Dev. Jun. 2005;71(2):140-4.
Tahara et al., Potent and Selective Inhibitors of 8-Oxoguanine DNA Glycosylase. J Am Chem Soc. Feb. 14, 2018;140(6):2105-2114. doi: 10.1021/jacs.7b09316. Epub Feb. 5, 2018.
Tajiri et al., Functional cooperation of MutT, MutM and MutY proteins in preventing mutations caused by spontaneous oxidation of guanine nucleotide in *Escherichia coli*. Mutat Res. May 1995;336(3):257-67. doi: 10.1016/0921-8777(94)00062-b.
Takimoto et al., Stereochemical basis for engineered pyrrolysyl-tRNA synthetase and the efficient in vivo incorporation of structurally divergent non-native amino acids. ACS Chem Biol. Jul. 15, 2011;6(7):733-43. doi: 10.1021/cb200057a. Epub May 5, 2011.
Tambunan et al., Vaccine Design for H5N1 Based on B- and T-cell Epitope Predictions. Bioinform Biol Insights. Apr. 28, 2016;10:27-35. doi: 10.4137/BBI.S38378.
Tanenbaum et al., A protein-tagging system for signal amplification in gene expression and fluorescence imaging. Cell. Oct. 23, 2014;159(3):635-46. doi: 10.1016/j.cell.2014.09.039. Epub Oct. 9, 2014.
Tanese et al., Expression of enzymatically active reverse transcriptase in *Escherichia coli*. Proc Natl Acad Sci U S A. Aug. 1985;82(15):4944-8. doi: 10.1073/pnas.82.15.4944.
Tang et al., Aptazyme-embedded guide RNAs enable ligand-responsive genome editing and transcriptional activation. Nat Commun. Jun. 28, 2017;8:15939. doi: 10.1038/ncomms15939.
Tang et al., Evaluation of Bioinformatic Programmes for the Analysis of Variants within Splice Site Consensus Regions. Adv Bioinformatics. 2016;2016:5614058. doi: 10.1155/2016/5614058. Epub May 24, 2016.
Tang et al., Rewritable multi-event analog recording in bacterial and mammalian cells. Science. Apr. 13, 2018;360(6385):eaap8992. doi: 10.1126/science.aap8992. Epub Feb. 15, 2018.
Tassabehji, Williams-Beuren syndrome: a challenge for genotype-phenotype correlations. Hum Mol Genet. Oct. 15, 2003;12 Spec No. 2:R229-37. doi: 10.1093/hmg/ddg299. Epub Sep. 2, 2003.
Taube et al., Reverse transcriptase of mouse mammary tumour virus: expression in bacteria, purification and biochemical characterization. Biochem J. Feb. 1, 1998;329 ( Pt 3)(Pt 3):579-87. doi: 10.1042/bj3290579. Erratum in: Biochem J Jun. 15, 1998;332(Pt 3):808.
Tebas et al., Gene editing of CCR5 in autologous CD4 T cells of persons infected with HIV. Engl J Med. Mar. 6, 2014;370(10):901-10. doi: 10.1056/NEJMoa1300662.
Tee et al., Polishing the craft of genetic diversity creation in directed evolution. Biotechnol Adv. Dec. 2013;31(8):1707-21. doi: 10.1016/j.biotechadv.2013.08.021. Epub Sep. 6, 2013.
Telenti et al., The *Mycobacterium xenopi* GyrA protein splicing element: characterization of a minimal intein. J Bacteriol. Oct. 1997;179(20):6378-82. doi: 10.1128/jb.179.20.6378-6382.1997.
Telesnitsky et al., RNase H domain mutations affect the interaction between Moloney murine leukemia virus reverse transcriptase and its primer-template. Proc Natl Acad Sci U S A. Feb. 15, 1993;90(4):1276-80. doi: 10.1073/pnas.90.4.1276.
Teng et al., Mutational analysis of apolipoprotein B mRNA editing enzyme (APOBEC1). structure-function relationships of RNA editing and dimerization. J Lipid Res. Apr. 1999;40(4):623-35.
Tessarollo et al., Targeted mutation in the neurotrophin-3 gene results in loss of muscle sensory neurons. Proc Natl Acad Sci U S A. Dec. 6, 1994;91(25):11844-8.
Tesson et al., Knockout rats generated by embryo microinjection of TALENs. Nat Biotechnol. Aug. 5, 2011;29(8):695-6. doi: 10.1038/nbt.1940.
Thompson et al., Cellular uptake mechanisms and endosomal trafficking of supercharged proteins. Chem Biol. Jul. 27, 2012;19(7):831-43. doi: 10.1016/j.chembiol.2012.06.014.
Thompson et al., Engineering and identifying supercharged proteins for macromolecule delivery into mammalian cells. Methods Enzymol. 2012;503:293-319. doi: 10.1016/B978-0-12396962-0.00012-4.

(56) References Cited

OTHER PUBLICATIONS

Thompson et al., The Future of Multiplexed Eukaryotic Genome Engineering. ACS Chem Biol. Feb. 16, 2018;13(2):313-325. doi: 10.1021/acschembio.7b00842. Epub Dec. 28, 2017.
Thomson et al., Mutational analysis of loxP sites for efficient Cre-mediated insertion into genomic DNA. Genesis. Jul. 2003;36(3):162-7. doi: 10.1002/gene.10211.
Thorpe et al., Functional correction of episomal mutations with short DNA fragments and RNA-DNA oligonucleotides. J Gene Med. Mar.-Apr. 2002;4(2):195-204.
Thuronyi et al., Continuous evolution of base editors with expanded target compatibility and improved activity. Nat Biotechnol. Sep. 2019;37(9):1070-1079. doi: 10.1038/s41587-019-0193-0. Epub Jul. 22, 2019.
Thyagarajan et al., Creation of engineered human embryonic stem cell lines using phiC31 integrase. Stem Cells. Jan. 2008;26(1):119-26. doi: 10.1634/stemcells.2007-0283. Epub Oct. 25, 2007.
Thyagarajan et al., Mammalian genomes contain active recombinase recognition sites. Gene. Feb. 22, 2000;244(1-2):47-54.
Thyagarajan et al., Site-specific genomic integration in mammalian cells mediated by phage phiC31 integrase. Mol Cell Biol. Jun. 2001;21(12):3926-34.
Tinland et al., The T-DNA-linked VirD2 protein contains two distinct functional nuclear localization signals. Proc Natl Acad Sci U S A. Aug. 15, 1992;89(16):7442-6. doi: 10.1073/pnas.89.16.7442.
Tirumalai et al., Recognition of core-type DNA sites by lambda integrase. J Mol Biol. Jun. 12, 1998;279(3):513-27.
Tom et al., Mechanism whereby proliferating cell nuclear antigen stimulates flap endonuclease 1. J Biol Chem. Apr. 7, 2000;275(14):10498-505. doi: 10.1074/jbc.275.14.10498.
Tone et al., Single-stranded DNA binding protein Gp5 of Bacillus subtilis phage ?29 is required for viral DNA replication in growth-temperature dependent fashion. Biosci Biotechnol Biochem. 2012;76(12):2351-3. doi: 10.1271/bbb.120587. Epub Dec. 7, 2012.
Toor et al., Crystal structure of a self-spliced group II intron. Science. Apr. 4, 2008;320(5872):77-82. doi: 10.1126/science.1153803.
Toro et al., On the Origin and Evolutionary Relationships of the Reverse Transcriptases Associated With Type III CRISPR-Cas Systems. Front Microbiol. Jun. 15, 2018;9:1317. doi: 10.3389/fmicb.2018.01317.
Toro et al., The Reverse Transcriptases Associated with CRISPR-Cas Systems. Sci Rep. Aug. 2, 2017;7(1):7089. doi: 10.1038/s41598-017-07828-y.
Torres et al., Non-integrative lentivirus drives high-frequency cre-mediated cassette exchange in human cells. PLoS One. 2011;6(5):e19794. doi: 10.1371/journal.pone.0019794. Epub May 23, 2011.
Tourdot et al., A general strategy to enhance immunogenicity of low-affinity HLA-A2. 1—associated peptides: implication in the identification of cryptic tumor epitopes. Eur J Immunol. Dec. 2000;30(12):3411-21.
Townsend et al., Role of HFE in iron metabolism, hereditary haemochromatosis, anaemia of chronic disease, and secondary iron overload. Lancet. Mar. 2, 2002;359(9308):786-90. doi: 10.1016/S0140-6736(02)07885-6.
Tracewell et al., Directed enzyme evolution: climbing fitness peaks one amino acid at a time. Curr Opin Chem Biol. Feb. 2009;13(1):3-9. doi: 10.1016/j.cbpa.2009.01.017. Epub Feb. 25, 2009.
Tratschin et al., A human parvovirus, adeno-associated virus, as a eucaryotic vector: transient expression and encapsidation of the procaryotic gene for chloramphenicol acetyltransferase. Mol Cell Biol. Oct. 1984;4(10):2072-81. doi: 10.1128/mcb.4.10.2072.
Tratschin et al., Adeno-associated virus vector for high-frequency integration, expression, and rescue of genes in mammalian cells. Mol Cell Biol. Nov. 1985;5(11):3251-60. doi: 10.1128/mcb.5.11.3251.
Trausch et al., The structure of a tetrahydrofolate-sensing riboswitch reveals two ligand binding sites in a single aptamer. Structure. Oct. 12, 2011;19(10):1413-23. doi: 10.1016/j.str.2011.06.019. Epub Sep. 8, 2011.
Traxler et al., A genome-editing strategy to treat ?-hemoglobinopathies that recapitulates a mutation associated with a benign genetic condition. Nat Med. Sep. 2016;22(9):987-90. doi: 10.1038/nm.4170. Epub Aug. 15, 2016.
Trojan et al., Functional analysis of hMLH1 variants and HNPCC-related mutations using a human expression system. Gastroenterology. Jan. 2002;122(1):211-9. doi: 10.1053/gast.2002.30296.
Trudeau et al., On the Potential Origins of the High Stability of Reconstructed Ancestral Proteins. Mol Biol Evol. Oct. 2016;33(10):2633-41. doi: 10.1093/molbev/msw138. Epub Jul. 12, 2016.
Truong et al., Development of an intein-mediated split-Cas9 system for gene therapy. Nucleic Acids Res. Jul. 27, 2015;43(13):6450-8. doi: 10.1093/nar/gkv601. Epub Jun. 16, 2015. With Supplementary Data.
Tsai et al., Guide-seq enables genome-wide profiling of off-target cleavage by CRISPR-Cas nucleases. Nat Biotechnol. Feb. 2015;33(2):187-197. doi: 10.1038/nbt.3117. Epub Dec. 16, 2014.
Tsai et al., Circle-seq: a highly sensitive in vitro screen for genome-wide CRISPR-Cas9 nuclease off-targets. Nat Methods. Jun. 2017;14(6):607-614. doi: 10.1038/nmeth.4278. Epub May 1, 2017.
Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.
Tsai et al., Guide-seq enables genome-wide profiling of off-target cleavage by CRISPR-Cas nucleases. Nat Biotechnol. Feb. 2015;33(2):187-97. doi: 10.1038/nbt.3117. Epub Dec. 16, 2014.
Tsang et al., Specialization of the DNA-cleaving activity of a group I ribozyme through in vitro evolution. J Mol Biol. Sep. 13, 1996;262(1):31-42. doi: 10.1006/jmbi.1996.0496.
Tsutakawa et al., Human flap endonuclease structures, DNA double-base flipping, and a unified understanding of the FEN1 superfamily. Cell. Apr. 15, 2011;145(2):198-211. doi: 10.1016/j.cell.2011.03.004.
Turan et al., Recombinase-mediated cassette exchange (RMCE)—a rapidly-expanding toolbox for targeted genomic modifications. Gene. Feb. 15, 2013;515(1):1-27. doi: 10.1016/j.gene.2012.11.016. Epub Nov. 29, 2012.
Turan et al., Recombinase-mediated cassette exchange (RMCE): traditional concepts and current challenges. J Mol Biol. Mar. 25, 2011;407(2):193-221. doi: 10.1016/j.jmb.2011.01.004. Epub Jan. 15, 2011.
Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.
Tycko et al., Pairwise library screen systematically interrogates *Staphylococcus aureus* Cas9 specificity in human cells. bioRxiv. doi: https://doi.org/10.1101/269399 Posted Feb. 22, 2018.
UniProt Consortium, UniProt: the universal protein knowledgebase. Nucleic Acids Res. Mar. 16, 2018;46(5):2699. doi: 10.1093/nar/gky092.
UniProt Submission; UniProt, Accession No. P01011. Last modified Jun. 11, 2014, version 2. 15 pages.
UniProt Submission; UniProt, Accession No. P01011. Last modified Sep. 18, 2013, version 2. 15 pages.
UniProt Submission; UniProt, Accession No. P04264. Last modified Jun. 11, 2014, version 6. 15 pages.
UniProt Submission; UniProt, Accession No. P04275. Last modified Jul. 9, 2014, version 107. 29 pages.
UniProtein A0A1V6. Dec. 11, 2019.
UniProtKB Submission; Accession No. F0NH53. May 3, 2011. 4 pages.
UniProtKB Submission; Accession No. F0NN87. May 3, 2011. 4 pages.
UniProtKB Submission; Accession No. G3ECR1.2. No Author Listed., Aug. 12, 2020, 8 pages.
UniProtKB Submission; Accession No. P04264. No Author Listed., Apr. 7, 2021. 12 pages.

(56) References Cited

OTHER PUBLICATIONS

UniProtKB Submission; Accession No. P0DOC6. No Author Listed., Oct. 5, 2016. 5 pages.
UniProtKB Submission; Accession No. T0D7A2. Oct. 16, 2013. 10 pages.
UniProtKB Submission; Accession No. U2UMQ6. No Author Listed., Apr. 7, 2021, 11 pages.
Urasaki et al., Functional dissection of the Tol2 transposable element identified the minimal cis-sequence and a highly repetitive sequence in the subterminal region essential for transposition. Genetics. Oct. 2006;174(2):639-49. doi: 10.1534/genetics.106.060244. Epub Sep. 7, 2006.
Urnov et al., Genome editing with engineered zinc finger nucleases. Nat Rev Genet. Sep. 2010;11(9):636-46. doi: 10.1038/nrg2842.
Urnov et al., Highly efficient endogenous human gene correction using designed zinc-finger nucleases. Nature. Jun. 2, 2005;435(7042):646-51. Epub Apr. 3, 2005.
Usman et al., Exploiting the chemical synthesis of RNA. Trends Biochem Sci. Sep. 1992;17(9):334-9. doi: 10.1016/0968-0004(92)90306-t.
Vagner et al., Efficiency of homologous DNA recombination varies along the Bacillus subtilis chromosome. J Bacteriol. Sep. 1988;170(9):3978-82.
Vakulskas et al., A high-fidelity Cas9 mutant delivered as a ribonucleoprotein complex enables efficient gene editing in human hematopoietic stem and progenitor cells. Nat Med. Aug. 2018;24(8):1216-1224. doi: 10.1038/s41591-018-0137-0. Epub Aug. 6, 2018.
Van Brunt et al., Genetically Encoded Azide Containing Amino Acid in Mammalian Cells Enables Site-Specific Antibody-Drug Conjugates Using Click Cycloaddition Chemistry. Bioconjug Chem. Nov. 18, 2015;26(11):2249-60. doi: 10.1021/acs.bioconjchem.5b00359. Epub Sep. 11, 2015.
Van Brunt et al., Molecular Farming: Transgenic Animals as Bioreactors. Biotechnology (Y). 1988;6(10):1149-1154. doi: 10.1038/nbt1088-1149.
Van Duyne et al., Teaching Cre to follow directions. Proc Natl Acad Sci U S A. Jan. 6, 2009;106(1):4-5. doi: 10.1073/pnas.0811624106. Epub Dec. 31, 2008.
Van Overbeek et al., DNA Repair Profiling Reveals Nonrandom Outcomes at Cas9-Mediated Breaks. Mol Cell. Aug. 18, 2016;63(4):633-646. doi: 10.1016/j.molcel.2016.06.037. Epub Aug. 4, 2016.
Van Swieten et al., A mutation in the fibroblast growth factor 14 gene is associated with autosomal dominant cerebellar ataxia [corrected]. Am J Hum Genet. Jan. 2003;72(1):191-9. Epub Dec. 13, 2002.
Van Wijk et al., Identification of 51 novel exons of the Usher syndrome type 2A (USH2A) gene that encode multiple conserved functional domains and that are mutated in patients with Usher syndrome type II. Am J Hum Genet. Apr. 2004;74(4):738-44. doi: 10.1086/383096. Epub Mar. 10, 2004.
Vanamee et al., FokI requires two specific DNA sites for cleavage. J Mol Biol. May 25, 2001;309(1):69-78.
Varga et al., Progressive vascular smooth muscle cell defects in a mouse model of Hutchinson-Gilford progeria syndrome. Proc Natl Acad Sci U S A. Feb. 28, 2006;103(9):3250-5. doi: 10.1073/pnas.0600012103. Epub Feb. 21, 2006.
Varshney et al., The regulation and functions of DNA and RNA G-quadruplexes. Nat Rev Mol Cell Biol. Aug. 2020;21(8):459-474. doi: 10.1038/s41580-020-0236-x. Epub Apr. 20, 2020.
Vellore et al., A group II intron-type open reading frame from the thermophile Bacillus (Geobacillus) stearothermophilus encodes a heat-stable reverse transcriptase. Appl Environ Microbiol. Dec. 2004;70(12):7140-7. doi: 10.1128/AEM.70.12.7140-7147.2004.
Venken et al., Genome-wide manipulations of *Drosophila melanogaster* with transposons, Flp recombinase, and ΦC31 integrase. Methods Mol Biol. 2012;859:203-28. doi: 10.1007/978-1-61779-603-6_12.
Verma, The reverse transcriptase. Biochim Biophys Acta. Mar. 21, 1977;473(1):1-38. doi: 10.1016/0304-419x(77)90005-1.
Vigne et al., Third-generation adenovectors for gene therapy. Restor Neurol Neurosci. Jan. 1, 1995;8(1):35-6. doi: 10.3233/RNN-1995-81208.
Vik et al., Endonuclease V cleaves at inosines in RNA. Nat Commun. 2013;4:2271. doi: 10.1038/ncomms3271.
Vilenchik et al., Endogenous DNA double-strand breaks: production, fidelity of repair, and induction of cancer. Proc Natl Acad Sci U S A. Oct. 28, 2003;100(22):12871-6. doi: 10.1073/pnas.2135498100. Epub Oct. 17, 2003.
Villiger et al., Treatment of a metabolic liver disease by in vivo genome base editing in adult mice. Nat Med. Oct. 2018;24(10):1519-1525. doi: 10.1038/s41591-018-0209-1. Epub Oct. 8, 2018.
Vitreschak et al., Regulation of the vitamin B12 metabolism and transport in bacteria by a conserved RNA structural element. RNA. Sep. 2003;9(9):1084-97.
Voigt et al., Rational evolutionary design: the theory of in vitro protein evolution. Adv Protein Chem. 2000;55:79-160.
Vriend et al., Nick-initiated homologous recombination: Protecting the genome, one strand at a time. DNA Repair (Amst). Feb. 2017;50:1-13. doi: 10.1016/j.dnarep.2016.12.005. Epub Dec. 29, 2016.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.
Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.
Wah et al., Structure of FokI has implications for DNA cleavage. Proc Natl Acad Sci U S A. Sep. 1, 1998;95(18):10564-9.
Wals et al., Unnatural amino acid incorporation in *E. coli*: current and future applications in the design of therapeutic proteins. Front Chem. Apr. 1, 2014;2:15. doi: 10.3389/fchem.2014.00015. eCollection 2014.
Wan et al., Material solutions for delivery of CRISPR/Cas-based genome editing tools: Current status and future outlook. Materials Today. Jun. 2019;26:40-66. doi: 10.1016/j.mattod.2018.12.003.
Wang et al. CRISPR-Cas9 and CRISPR-Assisted Cytidine Deaminase Enable Precise and Efficient Genome Editing in Klebsiella pneumoniae. Appl Environ Microbiol. 2018;84(23):e01834-18. Published Nov. 15, 2018. doi:10.1128/AEM.01834-18.
Wang et al., AID upmutants isolated using a high-throughput screen highlight the immunity/cancer balance limiting DNA deaminase activity. Nat Struct Mol Biol. Jul. 2009;16(7):769-76. doi: 10.1038/nsmb.1623. Epub Jun. 21, 2009.
Wang et al., Continuous directed evolutions of proteins with improved soluble expression. Nature Chemical Biology. Nat Publishing Group. Aug. 20, 2018; 14(10):972-980.
Wang et al., CRISPR-Cas9 Targeting of PCSK9 in Human Hepatocytes In Vivo-Brief Report. Arterioscler Thromb Vasc Biol. May 2016;36(5):783-6. doi: 10.1161/ATVBAHA.116.307227. Epub Mar. 3, 2016.
Wang et al., Efficient delivery of genome-editing proteins using bioreducible lipid nanoparticles. Proc Natl Acad Sci U S A. Feb. 29, 2016. pii: 201520244. [Epub ahead of print].
Wang et al., Enhanced base editing by co-expression of free uracil DNA glycosylase inhibitor. Cell Res. Oct. 2017;27(1):1289-92. doi: 10.1038/cr.2017.111. Epub Aug. 29, 2017.
Wang et al., Evolution of new nonantibody proteins via iterative somatic hypermutation. Proc Natl Acad Sci U S A. Nov. 30, 2004;101(48):16745-9. Epub Nov. 19, 2004.
Wang et al., Expanding the genetic code. Annu Rev Biophys Biomol Struct. 2006;35:225-49. Review.
Wang et al., Genetic screens in human cells using the CRISPR-Cas9 system. Science. Jan. 3, 2014;343(6166):80-4. doi: 10.1126/science.1246981. Epub Dec. 12, 2013.
Wang et al., Highly efficient CRISPR/HDR-mediated knock-in for mouse embryonic stem cells and zygotes. Biotechniques. 2015:59,201-2;204;206-8.

(56) References Cited

OTHER PUBLICATIONS

Wang et al., (6)-methyladenosine Modulates Messenger RNA Translation Efficiency. Cell. Jun. 4, 2015;161(6):1388-99. doi: 10.1016/j.cell.2015.05.014.
Wang et al., N6-methyladenosine-dependent regulation of messenger RNA stability. Nature. Jan. 2, 2014;505(7481):117-20. doi: 10.1038/nature12730. Epub Nov. 27, 2013.
Wang et al., Nucleation, propagation and cleavage of target RNAs in Ago silencing complexes. Nature. Oct. 8, 2009;461(7265):754-61. doi: 10.1038/nature08434.
Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.
Wang et al., Optimized paired-sgRNA/Cas9 cloning and expression cassette triggers high-efficiency multiplex genome editing in kiwifruit. Plant Biotechnol J. Aug. 2018;16(8):1424-1433. doi: 10.1111/pbi.12884. Epub Feb. 6, 2018.
Wang et al., Programming cells by multiplex genome engineering and accelerated evolution. Nature. Aug. 13, 2009;460(7257):894-8. Epub Jul. 26, 2009.
Wang et al., Reading RNA methylation codes through methyl-specific binding proteins. RNA Biol. 2014;11(6):669-72. doi: 10.4161/rna.28829. Epub Apr. 24, 2014.
Wang et al., Recombinase technology: applications and possibilities. Plant Cell Rep. Mar. 2011;30(3):267-85. doi: 10.1007/s00299-010-0938-1. Epub Oct. 24, 2010.
Wang et al., Riboswitches that sense S-adenosylhomocysteine and activate genes involved in coenzyme recycling. Mol Cell. Mar. 28, 2008;29(6):691-702. doi: 10.1016/j.molcel.2008.01.012.
Wang et al., *Staphylococcus aureus* protein SAUGI acts as a uracil-DNA glycosylase inhibitor. Nucleic Acids Res. Jan. 2014;42(2):1354-64. doi: 10.1093/nar/gkt964. Epub Oct. 22, 2013.
Wang et al., Structural basis of (6)-adenosine methylation by the METTL3-METTL14 complex. Nature. Jun. 23, 2016;534(7608):575-8. doi: 10.1038/nature18298. Epub May 25, 2016.
Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Wang et al., Uracil-DNA glycosylase inhibitor gene of bacteriophage PBS2 encodes a binding protein specific for uracil-DNA glycosylase. J Biol Chem. Jan. 15, 1989;264(2):1163-71.
Warren et al., A chimeric Cre recombinase with regulated directionality. Proc Natl Acad Sci U S A. Nov. 25, 2008;105(47):18278-83. doi: 10.1073/pnas.0809949105. Epub Nov. 14, 2008.
Warren et al., Mutations in the amino-terminal domain of lambda-integrase have differential effects on integrative and excisive recombination. Mol Microbiol. Feb. 2005;55(4):1104-12.
Watowich, The erythropoietin receptor: molecular structure and hematopoietic signaling pathways. J Investig Med. Oct. 2011;59(7):1067-72. doi: 10.2310/JIM.0b013e31820fb28c.
Waxman et al., Regulating excitability of peripheral afferents: emerging ion channel targets. Nat Neurosci. Feb. 2014;17(2):153-63. doi: 10.1038/nn.3602. Epub Jan. 28, 2014.
Weber et al., Assembly of designer TAL effectors by Golden Gate cloning. PLoS One. 2011;6(5):e19722. doi: 10.1371/journal.pone.0019722. Epub May 19, 2011.
Weill et al., DNA polymerases in adaptive immunity. Nat Rev Immunol. Apr. 2008;8(4):302-12. doi: 10.1038/nri2281. Epub Mar. 14, 2008.
Weinberg et al., New Classes of Self-Cleaving Ribozymes Revealed by Comparative Genomics Analysis. Nat Chem Biol. Aug. 2015;11(8):606-10. doi: 10.1038/nchembio.1846. Epub Jul. 13, 2015.
Weinberg et al., The aptamer core of SAM-IV riboswitches mimics the ligand-binding site of SAM-I riboswitches. RNA. May 2008;14(5):822-8. doi: 10.1261/rna.988608. Epub Mar. 27, 2008.
Weinberger et al., Disease-causing mutations C277R and C277Y modify gating of human ClC-1 chloride channels in myotonia congenita. J Physiol. Aug. 1, 2012;590(Pt 15):3449-64. doi: 0.1113/jphysiol.2012.232785. Epub May 28, 2012.
Weinert et al., Unbiased detection of CRISPR off-targets in vivo using Discover-Seq. Science. Apr. 19, 2019;364(6437):286-289. doi: 10.1126/science.aav9023. Epub Apr. 18, 2019.
Weiss et al., Loss-of-function mutations in sodium channel Nav1.7 cause anosmia. Nature. Apr. 14, 2011;472(7342):186-90. doi: 10.1038/nature09975. Epub Mar. 23, 2011.
Wen et al., Inclusion of a universal tetanus toxoid CD4(+) T cell epitope P2 significantly enhanced the immunogenicity of recombinant rotavirus ?VP8* subunit parenteral vaccines. Vaccine. Jul. 31, 2014;32(35):4420-4427. doi: 10.1016/j.vaccine.2014.06.060. Epub Jun. 21, 2014.
West et al., Gene expression in adeno-associated virus vectors: the effects of chimeric mRNA structure, helper virus, and adenovirus VA1 RNA. Virology. Sep. 1987;160(1):38-47. doi: 10.1016/0042-6822(87)90041-9.
Wharton et al., A new-specificity mutant of 434 repressor that defines an amino acid-base pair contact. Nature. Apr. 30-May 6, 1987;326(6116):888-91.
Wharton et al., Changing the binding specificity of a repressor by redesigning an alpha-helix. Nature. Aug. 15-21, 1985;316(6029):601-5.
Wheeler et al., The thermostability and specificity of ancient proteins. Curr Opin Struct Biol. Jun. 2016;38:37-43. doi: 10.1016/j.sbi.2016.05.015. Epub Jun. 9, 2016.
Wiedenheft et al., RNA-guided genetic silencing systems in bacteria and archaea. Nature. Feb. 15, 2012;482(7385):331-8. doi: 10.1038/nature10886. Review.
Wienert et al., KLF1 drives the expression of fetal hemoglobin in British HPFH. Blood. Aug. 10, 2017;130(6):803-807. doi: 10.1182/blood-2017-02-767400. Epub Jun. 28, 2017.
Wijesinghe et al., Efficient deamination of 5-methylcytosines in DNA by human APOBEC3A, but not by AID or APOBEC3G. Nucleic Acids Res. Oct. 2012;40(18):9206-17. doi: 10.1093/nar/gks685. Epub Jul. 13, 2012.
Wijnker et al., Managing meiotic recombination in plant breeding. Trends Plant Sci. Dec. 2008;13(12):640-6. doi: 10.1016/j.tplants.2008.09.004. Epub Oct. 22, 2008.
Williams et al., Assessing the accuracy of ancestral protein reconstruction methods. PLoS Comput Biol. Jun. 23, 2006;2(6):e69. doi: 10.1371/journal.pcbi.0020069. Epub Jun. 23, 2006.
Wills et al., Pseudoknot-dependent read-through of retroviral gag termination codons: importance of sequences in the spacer and loop 2. EMBO J. Sep. 1, 1994;13(17):4137-44. doi: 10.1002/j.1460-2075.1994.tb06731.x.
Wilson et al., Assessing annotation transfer for genomics: quantifying the relations between protein sequence, structure and function through traditional and probabilistic scores. J Mol Biol 2000;297:233-49.
Wilson et al., Formation of infectious hybrid virions with gibbon ape leukemia virus and human T-cell leukemia virus retroviral envelope glycoproteins and the gag and pol proteins of Moloney murine leukemia virus. J Virol. May 1989;63(5):2374-8. doi: 10.1128/JVI.63.5.2374-2378.1989.
Wilson et al., In Vitro Selection of Functional Nucleic Acids. Annu Rev Biochem. 1999;68:611-47. doi: 10.1146/annurev.biochem.68.1.611.
Wilson et al., Kinase dynamics. Using ancient protein kinases to unravel a modern cancer drug's mechanism. Science. Feb. 20, 2015;347(6224):882-6. doi: 10.1126/science.aaa1823.
Wilson et al., Programmable m6A modification of cellular RNAs with a Cas13-directed methyltransferase. Nat Biotechnol. Dec. 2020;38(12):1431-1440. doi: 10.1038/s41587-020-0572-6. Epub Jun. 29, 2020.
Winkler et al., An mRNA structure that controls gene expression by binding FMN. Proc Natl Acad Sci U S A. Dec. 10, 2002;99(25):15908-13. Epub Nov. 27, 2002.
Winkler et al., Control of gene expression by a natural metabolite-responsive ribozyme. Nature. Mar. 18, 2004;428(6980):281-6.
Winkler et al., Thiamine derivatives bind messenger RNAs directly to regulate bacterial gene expression. Nature. Oct. 31, 2002;419(6910):952-6. Epub Oct. 16, 2002.

(56) References Cited

OTHER PUBLICATIONS

Winoto et al., A novel, inducible and T cell-specific enhancer located at the 3' end of the T cell receptor alpha locus. EMBO J. Mar. 1989;8(3):729-33.
Winter et al., Drug Development. Phthalimide conjugation as a strategy for in vivo target protein degradation. Science. Jun. 19, 2015;348(6241):1376-81. doi:; 10.1126/science.aab1433. Epub May 21, 2015.
Winter et al., Targeted exon skipping with AAV-mediated split adenine base editors. Cell Discov. Aug. 20, 2019;5:41. doi: 10.1038/s41421-019-0109-7.
Wold, Replication protein A: a heterotrimeric, single-stranded DNA-binding protein required for eukaryotic DNA metabolism. Annu Rev Biochem. 1997;66:61-92. doi: 10.1146/annurev.biochem.66.1.61.
Wolf et al., tadA, an essential tRNA-specific adenosine deaminase from *Escherichia coli*. EMBO J. Jul. 15, 2002;21(14):3841-51.
Wolfe et al., Analysis of zinc fingers optimized via phage display: evaluating the utility of a recognition code. J Mol Biol. Feb. 5, 1999;285(5):1917-34.
Wong et al., A statistical analysis of random mutagenesis methods used for directed protein evolution. J Mol Biol. Jan. 27, 2006;355(4):858-71. Epub Nov. 17, 2005.
Wong et al., The Diversity Challenge in Directed Protein Evolution. Comb Chem High Throughput Screen. May 2006;9(4):271-88.
Wood et al., A genetic system yields self-cleaving inteins for bioseparations. Nat Biotechnol. Sep. 1999;17(9):889-92. doi: 10.1038/12879.
Wood et al., Targeted genome editing across species using ZFNs and TALENs. Science. Jul. 15, 2011;333(6040):307. doi: 10.1126/science.1207773. Epub Jun. 23, 2011.
Woods et al., The phenotype of congenital insensitivity to pain due to the NaV1.9 variant p.L811P. Eur J Hum Genet. May 2015;23(5):561-3. doi: 10.1038/ejhg.2014.166. Epub Aug. 13, 2014.
Wright et al., Continuous in vitro evolution of catalytic function. Science. Apr. 25, 1997;276(5312):614-7.
Wright et al., Rational design of a split-Cas9 enzyme complex. Proc Natl Acad Sci U S A. Mar. 10, 2015;112(10):2984-9. doi: 10.1073/pnas.1501698112. Epub Feb. 23, 2015.
Wu et al., Correction of a genetic disease in mouse via use of CRISPR-Cas9. Cell Stem Cell. Dec. 5, 2013;13(6):659-62. doi: 10.1016/j.stem.2013.10.016.
Wu et al., Genome-wide binding of the CRISPR endonuclease Cas9 in mammalian cells. Nat Biotechnol. Jul. 2014;32(7):670-6. doi: 10.1038/nbt.2889. Epub Apr. 20, 2014.
Wu et al., Human single-stranded DNA binding proteins: guardians of genome stability. Acta Biochim Biophys Sin (Shanghai). Jul. 2016;48(7):671-7. doi: 10.1093/abbs/gmw044. Epub May 23, 2016.
Wu et al., Protein trans-splicing and functional mini-inteins of a cyanobacterial dnaB intein. Biochim Biophys Acta. Sep. 8, 1998;1387(1-2):422-32. doi: 10.1016/s0167-4838(98)00157-5.
Wu et al., Protein trans-splicing by a split intein encoded in a split DnaE gene of *Synechocystis* sp. PCC6803. Proc Natl Acad Sci U S A. Aug. 4, 1998;95(16):9226-31. doi: 10.1073/pnas.95.16.9226.
Wu et al., Readers, writers and erasers of N6-methylated adenosine modification. Curr Opin Struct Biol. Dec. 2017;47:67-76. doi: 10.1016/j.sbi.2017.05.011. Epub Jun. 16, 2017.
Xiang et al., RNA m6A methylation regulates the ultraviolet-induced DNA damage response. Nature. Mar. 23, 2017;543(7646):573-576. doi: 10.1038/nature21671. Epub Mar. 15, 2017.
Xiao et al., Genetic incorporation of multiple unnatural amino acids into proteins in mammalian cells. Angew Chem Int Ed Engl. Dec. 23, 2013;52(52):14080-3. doi: 10.1002/anie.201308137. Epub Nov. 8, 2013.
Xiao et al., Nuclear m(6)A Reader YTHDC1 Regulates mRNA Splicing. Mol Cell. Feb. 18, 2016;61(4):507-519. doi: 10.1016/j.molcel.2016.01.012. Epub Feb. 11, 2016.
Xie et al., Adjusting the attB site in donor plasmid improves the efficiency of ?C31 integrase system. DNA Cell Biol. Jul. 2012;31(7):1335-40. doi: 10.1089/dna.2011.1590. Epub Apr. 10, 2012.
Xiong et al., Origin and evolution of retroelements based upon their reverse transcriptase sequences. EMBO J. Oct. 1990;9(10):3353-62.
Xu et al., Accuracy and efficiency define Bxb1 integrase as the best of fifteen candidate serine recombinases for the integration of DNA into the human genome. BMC Biotechnol. Oct. 20, 2013;13:87. doi: 10.1186/1472-6750-13-87.
Xu et al., Chemical ligation of folded recombinant proteins: segmental isotopic labeling of domains for NMR studies. Proc Natl Acad Sci U S A. Jan. 19, 1999;96(2):388-93. doi: 10.1073/pnas.96.2.388.
Xu et al., Multiplex nucleotide editing by high-fidelity Cas9 variants with improved efficiency in rice. BMC Plant Biol. 2019;19(1):511. Published Nov. 21, 2019. doi: 10.1186/s12870-019-2131-1. Includes supplementary data and materials.
Xu et al., Protein splicing: an analysis of the branched intermediate and its resolution by succinimide formation. EMBO J. Dec. 1, 1994;13(23):5517-22.
Xu et al., PTMD: A Database of Human Disease-associated Post-translational Modifications. Genomics Proteomics Bioinformatics. Aug. 2018;16(4):244-251. doi: 10.1016/j.gpb.2018.06.004. Epub Sep. 21, 2018.
Xu et al., Sequence determinants of improved CRISPR sgRNA design. Genome Res. Aug. 2015;25(8):1147-57. doi: 10.1101/gr.191452.115. Epub Jun. 10, 2015.
Xu et al., Structures of human ALKBH5 demethylase reveal a unique binding mode for specific single-stranded N6-methyladenosine RNA demethylation. J Biol Chem. Jun. 20, 2014;289(25):17299-311. doi: 10.1074/jbc.M114.550350. Epub Apr. 28, 2014.
Xu et al., The mechanism of protein splicing and its modulation by mutation. EMBO J. Oct. 1, 1996;15(19):5146-53.
Yahata et al., Unified, Efficient, and Scalable Synthesis of Halichondrins: Zirconium/Nickel-Mediated One-Pot Ketone Synthesis as the Final Coupling Reaction. Angew Chem Int Ed Engl. Aug. 28, 2017;56(36):10796-10800. doi: 10.1002/anie.201705523. Epub Jul. 28, 2017.
Yamada et al., Crystal Structure of the Minimal Cas9 from Campylobacter jejuni Reveals the Molecular Diversity in the CRISPR-Cas9 Systems. Mol Cell. Mar. 16, 2017;65(6):P1109-1121. /doi.org/10.1016/j.molcel.2017.02.007.
Yamamoto et al., The ons and offs of inducible transgenic technology: a review. Neurobiol Dis. Dec. 2001;8(6):923-32.
Yamamoto et al., Virological and immunological bases for HIV-1 vaccine design. Uirusu 2007;57(2):133-139. https://doi.org/10.2222/jsv.57.133.
Yamano et al., Crystal Structure of Cpf1 in Complex with Guide RNA and Target DNA. Cell. May 5, 2016;165(4):949-62 and Supplemental Info. doi: 10.1016/j.cell.2016.04.003. Epub Apr. 21, 2016.
Yamano et al., Crystal Structure of Cpf1 in Complex with Guide RNA and Target DNA. Cell. May 5, 2016;165(4):949-62. doi: 10.1016/j.cell.2016.04.003. Epub Apr. 21, 2016.
Yamazaki et al., Segmental Isotope Labeling for Protein NMR Using Peptide Splicing. J. Am. Chem. Soc. May 22, 1998; 120(22):5591-2. https://doi.org/10.1021/ja9807760.
Yan et al., Cas13d Is a Compact RNA-Targeting Type VI CRISPR Effector Positively Modulated by a WYL-Domain-Containing Accessory Protein. Mol Cell. Apr. 19, 2018;70(2):327-339.e5. doi: 10.1016/j.molcel.2018.02.028. Epub Mar. 15, 2018.
Yan et al., Functionally diverse type V CRISPR-Cas systems. Science. Jan. 4, 2019;363(6422):88-91. doi: 10.1126/science.aav7271. Epub Dec. 6, 2018.
Yan et al., Highly Efficient A•T to G•C Base Editing by Cas9n-Guided tRNA Adenosine Deaminase in Rice. Mol Plant. Apr. 2, 2018;11(4):631-634. doi: 10.1016/j.molp.2018.02.008. Epub Feb. 22, 2018.
Yang et al., A Tale of Two Moieties: Rapidly Evolving CRISPR/Cas-Based Genome Editing. Trends Biochem Sci. Oct. 2020;45(10):874-888. doi: 10.1016/j.tibs.2020.06.003. Epub Jun. 30, 2020.

(56) References Cited

OTHER PUBLICATIONS

Yang et al., APOBEC: From mutator to editor. J Genet Genomics. Sep. 20, 2017;44(9):423-437. doi: 10.1016/j.jgg.2017.04.009. Epub Aug. 7, 2017.
Yang et al., BRCA2 function in DNA binding and recombination from a BRCA2-DSS1-ssDNA structure. Science. Sep. 13, 2002;297(5588):1837-48. doi: 10.1126/science.297.5588.1837.
Yang et al., Construction of an integration-proficient vector based on the site-specific recombination mechanism of enterococcal temperate phage phiFC1. J Bacteriol. Apr. 2002;184(7):1859-64. doi: 10.1128/jb.184.7.1859-1864.2002.
Yang et al., Engineering and optimising deaminase fusions for genome editing. Nat Commun. Nov. 2, 2016;7:13330. doi: 10.1038/ncomms13330.
Yang et al., Genome editing with targeted deaminases. BioRxiv. Preprint. First posted online Jul. 28, 2016.
Yang et al., Genome-wide inactivation of porcine endogenous retroviruses (PERVs). Science. Nov. 27, 2015;350(6264):1101-4. doi: 10.1126/science.aad1191. Epub Oct. 11, 2015.
Yang et al., Increasing targeting scope of adenosine base editors in mouse and rat embryos through fusion of TadA deaminase with Cas9 variants. Protein Cell. Sep. 2018;9(9):814-819. doi: 10.1007/s13238-018-0568-x.
Yang et al., Mutations in SCN9A, encoding a sodium channel alpha subunit, in patients with primary erythermalgia. J Med Genet. Mar. 2004;41(3):171-4. doi: 10.1136/jmg.2003.012153.
Yang et al., New CRISPR-Cas systems discovered. Cell Res. Mar. 2017;27(3):313-314. doi: 10.1038/cr.2017.21. Epub Feb. 21, 2017.
Yang et al., One Prime for All Editing. Cell. Dec. 12, 2019;179(7):1448-1450. doi: 10.1016/j.cell.2019.11.030.
Yang et al., One-step generation of mice carrying reporter and conditional alleles by CRISPR/Cas-mediated genome engineering. Cell. Sep. 12, 2013;154(6):1370-9. doi: 10.1016/j.cell.2013.08.022. Epub Aug. 29, 2013.
Yang et al., PAM-dependent Target DNA Recognition and Cleavage by C2C1 CRISPR-Cas endonuclease. Cell Dec. 2016;167(7):1814-28.
Yang et al., Permanent genetic memory with >1-byte capacity. Nat Methods. Dec. 2014;11(12):1261-6. doi: 10.1038/nmeth.3147. Epub Oct. 26, 2014.
Yang et al., Preparation of RNA-directed DNA polymerase from spleens of Balb-c mice infected with Rauscher leukemia virus. Biochem Biophys Res Commun. Apr. 28, 1972;47(2):505-11. doi: 10.1016/0006-291x(72)90743-7.
Yang et al., Small-molecule control of insulin and PDGF receptor signaling and the role of membrane attachment. Curr Biol. Jan. 1, 1998;8(1):11-8. doi: 10.1016/s0960-9822(98)70015-6.
Yang et al., The BRCA2 homologue Brh2 nucleates RAD51 filament formation at a dsDNA-ssDNA junction. Nature. Feb. 10, 2005;433(7026):653-7. doi: 10.1038/nature03234.
Yang, Development of Human Genome Editing Tools for the Study of Genetic Variations and Gene Therapies. Doctoral Dissertation. Harvard University. 2013. Accessible via nrs.harvard.edu/urn-3:HUL.InstRepos:11181072. 277 pages.
Yang, Nucleases: diversity of structure, function and mechanism. Q Rev Biophys. Feb. 2011;44(1):1-93. doi: 10.1017/S0033583510000181. Epub Sep. 21, 2010.
Yang, PAML 4: phylogenetic analysis by maximum likelihood. Mol Biol Evol. Aug. 2007;24(8):1586-91. doi: 10.1093/molbev/msm088. Epub May 4, 2007.
Yang, Phylogenetic Analysis by Maximum Likelihood (PAML). //abacus.gene.ucl.ac.uk/software/paml.html Last accessed Apr. 28, 2021.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yasui et al., Miscoding Properties of 2'-Deoxyinosine, a Nitric Oxide-Derived DNA Adduct, during Translesion Synthesis Catalyzed by Human DNA Polymerases. J Molec Biol. Apr. 4, 2008;377(4):1015-23.
Yasui, Alternative excision repair pathways. Cold Spring Harb Perspect Biol. Jun. 1, 2013;5(6):a012617. doi: 10.1101/cshperspect.a012617.
Yasukawa et al., Characterization of Moloney murine leukaemia virus/avian myeloblastosis virus chimeric reverse transcriptases. J Biochem. Mar. 2009;145(3):315-24. doi: 10.1093/jb/mvn166. Epub Dec. 6, 2008.
Yazaki et al., Hereditary systemic amyloidosis associated with a new apolipoprotein AII stop codon mutation Stop78Arg. Kidney Int. Jul. 2003;64(1):11-6.
Yeh et al., In vivo base editing of post-mitotic sensory cells. Nat Commun. Jun. 5, 2018;9(1):2184. doi: 10.1038/s41467-018-04580-3.
Yeh et al., In vivo base editing restores sensory transduction and transiently improves auditory function in a mouse model of recessive deafness. Sci Transl Med. Jun. 3, 2020;12(546):eaay9101. doi: 10.1126/scitranslmed.aay9101.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Yokoe et al., Spatial dynamics of GFP-tagged proteins investigated by local fluorescence enhancement. Nat Biotechnol. Oct. 1996;14(10):1252-6. doi: 10.1038/nbt1096-1252.
Young et al., Beyond the canonical 20 amino acids: expanding the genetic lexicon. J Biol Chem. Apr. 9, 2010;285(15):11039-44. doi: 10.1074/jbc.R109.091306. Epub Feb. 10, 2010.
Yu et al., Circular permutation: a different way to engineer enzyme structure and function. Trends Biotechnol. Jan. 2011;29(1):18-25. doi: 10.1016/j.tibtech.2010.10.004. Epub Nov. 17, 2010.
Yu et al., Dynamic control of Rad51 recombinase by self-association and interaction with BRCA2. Mol Cell. Oct. 2003;12(4):1029-41. doi: 10.1016/s1097-2765(03)00394-0.
Yu et al., Liposome-mediated in vivo E1A gene transfer suppressed dissemination of ovarian cancer cells that overexpress HER-2/neu. Oncogene. Oct. 5, 1995;11(7):1383-8.
Yu et al., Progress towards gene therapy for HIV infection. Gene Ther. Jan. 1994;1(1):13-26.
Yu et al., Small molecules enhance CRISPR genome editing in pluripotent stem cells. Cell Stem Cell. Feb. 5, 2015;16(2):142-7. doi: 10.1016/j.stem.2015.01.003.
Yu et al., Synthesis-dependent microhomology-mediated end joining accounts for multiple types of repair junctions. Nucleic Acids Res. Sep. 2010;38(17):5706-17. doi: 10.1093/nar/gkq379. Epub May 11, 2010.
Yuan et al., Laboratory-directed protein evolution. Microbiol Mol Biol Rev. 2005; 69(3):373-92. PMID: 16148303.
Yuan et al., Tetrameric structure of a serine integrase catalytic domain. Structure. Aug. 6, 2008;16(8):1275-86. doi: 10.1016/j.str.2008.04.018.
Yuen et al., Control of transcription factor activity and osteoblast differentiation in mammalian cells using an evolved small-molecule-dependent intein. J Am Chem Soc. Jul. 12, 2006;128(27):8939-46.
Zakas et al., Enhancing the pharmaceutical properties of protein drugs by ancestral sequence reconstruction. Nat Biotechnol. Jan. 2017;35(1):35-37. doi: 10.1038/nbt.3677. Epub Sep. 26, 2016.
Zalatan et al., Engineering complex synthetic transcriptional programs with CRISPR RNA scaffolds. Cell. Jan. 15, 2015;160(1-2):339-50. doi: 10.1016/j.cell.2014.11.052. Epub Dec. 18, 2014.
Zelphati et al., Intracellular delivery of proteins with a new lipid-mediated delivery system. J Biol Chem. Sep. 14, 2001;276(37):35103-10. Epub Jul. 10, 2001.
Zeng et al., Correction of the Marfan Syndrome Pathogenic FBN1 Mutation by Base Editing in Human Cells and Heterozygous Embryos. Mol Ther. Nov. 7, 2018;26(11):2631-2637. doi: 10.1016/j.ymthe.2018.08.007. Epub Aug. 14, 2018.
Zetsche et al., A split-Cas9 architecture for inducible genome editing and transcription modulation. Nat Biotechnol. Feb. 2015;33(2):139-42. doi: 10.1038/nbt.3149.

(56) References Cited

OTHER PUBLICATIONS

Zetsche et al., Cpf1 is a single RNA-guided endonuclease of a class 2 CRISPR-Cas system. Cell. Oct. 22, 2015;163(3):759-71 and Supplemental Info. doi: 10.1016/j.cell.2015.09.038. Epub Sep. 25, 2015.
Zetsche et al., Cpf1 is a single RNA-guided endonuclease of a class 2 CRISPR-Cas system. Cell. Oct. 22, 2015;163(3):759-71. doi: 10.1016/j.cell.2015.09.038. Epub Sep. 25, 2015.
Zettler et al., The naturally split Npu DnaE intein exhibits an extraordinarily high rate in the protein trans-splicing reaction. FEBS Lett. Mar. 4, 2009;583(5):909-14. doi: 10.1016/j.febslet.2009.02.003. Epub Feb. 10, 2009.
Zhang et al., π-Clamp-mediated cysteine conjugation. Nat Chem. Feb. 2016;8(2):120-8. doi: 10.1038/nchem.2413. Epub Dec. 21, 2015.
Zhang et al., A new strategy for the site-specific modification of proteins in vivo. Biochemistry. Jun. 10, 2003;42(22):6735-46.
Zhang et al., Circular intronic long noncoding RNAs. Mol Cell. Sep. 26, 2013;51(6):792-806. doi: 10.1016/j.molcel.2013.08.017. Epub Sep. 12, 2013.
Zhang et al., Comparison of non-canonical PAMs for CRISPR/Cas9-mediated DNA cleavage in human cells. Sci Rep. Jun. 2014;4:5405.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Copy number variation in human health, disease, and evolution. Annu Rev Genomics Hum Genet. 2009;10:451-81. doi: 10.1146/annurev.genom.9.081307.164217.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zhang et al., Efficient precise knockin with a double cut HDR donor after CRISPR/Cas9-mediated double-stranded DNA cleavage. Genome Biol. Feb. 20, 2017;18(1):35. doi: 10.1186/s13059-017-1164-8.
Zhang et al., Global analysis of small RNA and mRNA targets of Hfq. Mol Microbiol. Nov. 2003;50(4):1111-24. doi: 10.1046/j.1365-2958.2003.03734.x.
Zhang et al., Myoediting: Toward Prevention of Muscular Dystrophy by Therapeutic Genome Editing. Physiol Rev. Jul. 1, 2018;98(3):1205-1240. doi: 10.1152/physrev.00046.2017.
Zhang et al., Programmable base editing of zebrafish genome using a modified CRISPR-Cas9 system. Nat Commun. Jul. 25, 2017;8(1):118. doi: 10.1038/s41467-017-00175-6.
Zhang et al., Reversible RNA Modification N1-methyladenosine (m1A) in mRNA and tRNA. Genomics Proteomics Bioinformatics. Jun. 2018;16(3):155-161. doi: 10.1016/j.gpb.2018.03.003. Epub Jun. 14, 2018.
Zhang et al., Ribozymes and Riboswitches: Modulation of RNA Function by Small Molecules. Biochemistry. Nov. 2, 2010;49(43):9123-31. doi: 10.1021/bi1012645.
Zhang et al., Stabilized plasmid-lipid particles for regional gene therapy: formulation and transfection properties. Gene Ther. Aug. 1999;6(8):1438-47.
Zhao et al., An ultraprocessive, accurate reverse transcriptase encoded by a metazoan group II intron. RNA. Feb. 2018;24(2):183-195. doi: 10.1261/rna.063479.117. Epub Nov. 6, 2017.
Zhao et al., Crystal structures of a group II intron maturase reveal a missing link in spliceosome evolution. Nat Struct Mol Biol. Jun. 2016;23(6):558-65. doi: 10.1038/nsmb.3224. Epub May 2, 2016.
Zhao et al., Post-transcriptional gene regulation by mRNA modifications. Nat Rev Mol Cell Biol. Jan. 2017;18(1):31-42. doi: 10.1038/nrm.2016.132. Epub Nov. 3, 2016.
Zheng et al., ALKBH5 is a mammalian RNA demethylase that impacts RNA metabolism and mouse fertility. Mol Cell. Jan. 1, 20130;49(1):18-29. doi: 10.1016/j.molcel.2012.10.015. Epub Nov. 2, 20121.
Zheng et al., DNA editing in DNA/RNA hybrids by adenosine deaminases that act on RNA. Nucleic Acids Res. Apr. 7, 2017;45(6):3369-3377. doi: 10.1093/nar/gkx050.
Zheng et al., Highly efficient base editing in bacteria using a Cas9-cytidine deaminase fusion. Commun Biol. Apr. 1, 20189;1:32. doi: 10.1038/s42003-018-0035-5.
Zheng et al., Structural basis for the complete resistance of the human prion protein mutant G127V to prion disease. Sci Rep. Sep. 4, 2018;8(1):13211. doi: 10.1038/s41598-018-31394-6.
Zhong et al., Rational Design of Aptazyme Riboswitches for Efficient Control of Gene Expression in Mammalian Cells. Elife. Nov. 2, 2016;5:e18858. doi: 10.7554/eLife.18858.
Zhou et al., Cas12a variants designed for lower genome-wide off-target effect through stringent PAM recognition. Mol Ther. Jan. 5, 2022;30(1):244-255. doi: 10.1016/j.ymthe.2021.10.010. Epub Oct. 2, 20210.
Zhou et al., Dynamic m(6)A mRNA methylation directs translational control of heat shock response. Nature. Oct. 2, 20152;526(7574):591-4. doi: 10.1038/nature15377. Epub Oct. 1, 20152.
Zhou et al., GISSD: Group I Intron Sequence and Structure Database. Nucleic Acids Res. Jan. 2008;36(Database issue):D31-7. doi: 10.1093/nar/gkm766. Epub Oct. 1, 20076.
Zhou et al., Off-target RNA mutation induced by DNA base editing and its elimination by mutagenesis. Nature. Jul. 2019;571(7764):275-278. doi: 10.1038/s41586-019-1314-0. Epub Jun. 1, 20190.
Zhou et al., Protective V127 prion variant prevents prion disease by interrupting the formation of dimer and fibril from molecular dynamics simulations. Sci Rep. Feb. 2, 20164;6:21804. doi: 10.1038/srep21804.
Zhou et al., Seamless Genetic Conversion of SMN2 to SMN1 via CRISPR/Cpf1 and Single-Stranded Oligodeoxynucleotides in Spinal Muscular Atrophy Patient-Specific Induced Pluripotent Stem Cells. Hum Gene Ther. Nov. 2018;29(11):1252-1263. doi: 10.1089/hum.2017.255. Epub May 9, 2018.
Zielenski, Genotype and phenotype in cystic fibrosis. Respiration. 2000;67(2):117-33. doi: 10.1159/000029497.
Zimmerly et al., An Unexplored Diversity of Reverse Transcriptases in Bacteria. Microbiol Spectr. Apr. 2015;3(2):MDNA3-0058-2014. doi: 10.1128/microbiolspec.MDNA3-0058-2014.
Zimmerly et al., Group II intron mobility occurs by target DNA-primed reverse transcription. Cell. Aug. 25, 1995;82(4):545-54. doi: 10.1016/0092-8674(95)90027-6.
Zimmermann et al., Molecular interactions and metal binding in the theophylline-binding core of an RNA aptamer. RNA. May 2000;6(5):659-67.
Zolotukhin et al., Production and purification of serotype 1, 2, and 5 recombinant adeno-associated viral vectors. Methods. Oct. 2002;28(2):158-67. doi: 10.1016/s1046-2023(02)00220-7.
Zong et al., Precise base editing in rice, wheat and maize with a Cas9-cytidine deaminase fusion. Nat Biotechnol. May 2017;35(5):438-440. doi: 10.1038/nbt.3811. Epub Feb. 27, 2017.
Zorko et al., Cell-penetrating peptides: mechanism and kinetics of cargo delivery. Adv Drug Deliv Rev. Feb. 28, 2005;57(4):529-45. Epub Jan. 22, 2005.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Zufferey et al., Woodchuck hepatitis virus posttranscriptional regulatory element enhances expression of transgenes delivered by retroviral vectors. J Virol. Apr. 1999;73(4):2886-92. doi: 10.1128/JVI.73.4.2886-2892.1999.
Zuker et al., Optimal computer folding of large RNA sequences using thermodynamics and auxiliary information. Nucleic Acids Res. Jan. 10, 1981;9(1):133-48. doi: 10.1093/nar/9.1.133.
Zuo et al., Cytosine base editor generates substantial off-target single-nucleotide variants in mouse embryos. Science. Apr. 19, 2019;364(6437):289-292. doi: 10.1126/science.aav9973. Epub Feb. 28, 2019.
Zuris et al., Cationic lipid-mediated delivery of proteins enables efficient protein-based genome editing in vitro and in vivo. Nat Biotechnol. 2015;33:73-80.

(56) References Cited

OTHER PUBLICATIONS

U.S. Appl. No. 18/460,178, filed Sep. 1, 2023, Liu et al.
U.S. Appl. No. 18/791,223, filed Jul. 31, 2024, Liu et al.
U.S. Appl. No. 17/910,552, filed Sep. 9, 2022, Liu et al.
U.S. Appl. No. 17/797,700, filed Aug. 4, 2022, Liu et al.
U.S. Appl. No. 17/795,819, filed Jul. 27, 2022, Liu et al.
U.S. Appl. No. 17/797,701, filed Aug. 4, 2022, Liu et al.
U.S. Appl. No. 18/053,269, filed Nov. 7, 2022, Liu et al.
U.S. Appl. No. 18/534,489, filed Dec. 8, 2023, Liu et al.
U.S. Appl. No. 18/619,518, filed Mar. 28, 2024, Liu et al.
U.S. Appl. No. 17/797,697, filed Aug. 4, 2022, Liu et al.
U.S. Appl. No. 17/921,971, filed Oct. 27, 2022, Liu et al.
U.S. Appl. No. 18/064,738, filed Dec. 12, 2022, Liu et al.
U.S. Appl. No. 18/326,588, filed May 31, 2023, Liu et al.
U.S. Appl. No. 18/326,634, filed May 31, 2023, Liu et al.
U.S. Appl. No. 18/326,689, filed May 31, 2023, Liu et al.
U.S. Appl. No. 18/326,708, filed May 31, 2023, Liu et al.
U.S. Appl. No. 18/646,267, filed Apr. 25, 2024, Liu et al.
U.S. Appl. No. 18/323,245, filed May 24, 2023, Liu et al.
U.S. Appl. No. 18/028,183, filed Mar. 23, 2023, Liu et al.
U.S. Appl. No. 18/271,656, filed Jul. 10, 2023, Liu et al.
U.S. Appl. No. 18/579,685, filed Jan. 16, 2024, Liu et al.
U.S. Appl. No. 18/286,547, filed Oct. 11, 2023, Liu et al.
U.S. Appl. No. 18/715,569, filed May 31, 2024, Liu et al.
U.S. Appl. No. 18/568,796, filed Dec. 8, 2023, Liu et al.
U.S. Appl. No. 18/704,328, filed Apr. 24, 2024, Liu et al.
U.S. Appl. No. 18/715,587, filed May 31, 2024, Liu et al.
U.S. Appl. No. 18/715,578, filed May 31, 2024, Liu et al.
U.S. Appl. No. 18/681,490, filed Feb. 5, 2024, Liu et al.
U.S. Appl. No. 18/654,704, filed May 3, 2024, Liu et al.
U.S. Appl. No. 17/937,203, filed Sep. 30, 2022, Liu et al.
U.S. Appl. No. 18/069,898, filed Dec. 21, 2022, Liu et al.
U.S. Appl. No. 18/732,559, filed Jun. 3, 2024, Liu et al.
U.S. Appl. No. 18/055,274, filed Nov. 14, 2022, Maianti et al.
U.S. Appl. No. 15/852,891, filed Dec. 22, 2017, Maianti et al.
U.S. Appl. No. 16/926,436, filed Jul. 10, 2020, Maianti et al.
U.S. Appl. No. 18/484,381, filed Oct. 10, 2023, Maianti et al.
U.S. Appl. No. 15/852,526, filed Dec. 22, 2017, Maianti et al.
U.S. Appl. No. 16/492,534, filed Sep. 9, 2019, Liu et al.
U.S. Appl. No. 16/324,476, filed Feb. 8, 2019, Liu et al.
U.S. Appl. No. 18/324,394, filed May 26, 2023, Liu et al.
U.S. Appl. No. 15/791,085, filed Oct. 23, 2017, Liu et al.
U.S. Appl. No. 16/143,370, filed Sep. 26, 2018, Liu et al.
U.S. Appl. No. 17/148,059, filed Jan. 13, 2021, Liu et al.
U.S. Appl. No. 18/174,569, filed Feb. 24, 2023, Liu et al.
U.S. Appl. No. 18/641,299, filed Apr. 19, 2024, Liu et al.
U.S. Appl. No. 18/545,977, filed Dec. 19, 2023, Maianti et al.
U.S. Appl. No. 18/059,308, filed Nov. 28, 2022, Liu et al.
U.S. Appl. No. 18/066,878, filed Dec. 15, 2022, Liu et al.
U.S. Appl. No. 18/178,048, filed Mar. 3, 2023, Liu et al.
U.S. Appl. No. 17/289,665, filed Apr. 28, 2021, Liu et al.
U.S. Appl. No. 16/756,432, filed Apr. 15, 2020, Liu et al.
U.S. Appl. No. 16/772,747, filed Jun. 12, 2020, Shen et al.
U.S. Appl. No. 17/425,261, filed Jul. 22, 2021, Kim et al.
U.S. Appl. No. 17/057,398, filed Nov. 20, 2020, Liu et al.
U.S. Appl. No. 17/259,147, filed Jan. 8, 2021, Liu et al.
U.S. Appl. No. 17/270,396, filed Feb. 22, 2021, Liu et al.
U.S. Appl. No. 17/273,688, filed Mar. 4, 2021, Liu et al..
U.S. Appl. No. 17/294,287, filed May 14, 2021, Liu et al.
U.S. Appl. No. 17/288,504, filed Apr. 23, 2021, Liu et al.
U.S. Appl. No. 17/633,573, filed Feb. 7, 2022, Liu et al.
U.S. Appl. No. 17/436,048, filed Sep. 2, 2021, Liu et al.
U.S. Appl. No. 17/219,590, filed Mar. 31, 2021, Liu et al.
U.S. Appl. No. 17/602,738, filed Oct. 8, 2021, Liu et al.
U.S. Appl. No. 17/613,025, filed Nov. 19, 2021, Liu et al.
U.S. Appl. No. 17/300,668, filed Sep. 17, 2021, Liu et al.
U.S. Appl. No. 17/779,953, filed May 25, 2022, Liu et al.
U.S. Appl. No. 17/767,777, filed Apr. 8, 2022, Liu et al.
U.S. Appl. No. 17/219,635, filed Mar. 31, 2021, Liu et al.
U.S. Appl. No. 17/219,672, filed Mar. 31, 2021, Liu et al.
U.S. Appl. No. 17/751,599, filed May 23, 2022, Liu et al.
U.S. Appl. No. 17/440,682, filed Sep. 17, 2021, Liu et al.
U.S. Appl. No. 14/234,031, filed Mar. 24, 2014, Liu et al.
U.S. Appl. No. 14/320,271, filed Jun. 30, 2014, Liu et al.
U.S. Appl. No. 16/441,751, filed Jun. 14, 2019, Liu et al.
U.S. Appl. No. 14/320,519, filed Jun. 30, 2014, Liu et al.
U.S. Appl. No. 14/913,458, filed Feb. 22, 2016, Liu et al.
U.S. Appl. No. 16/266,937, filed Feb. 4, 2019, Liu et al.
U.S. Appl. No. 14/320,370, filed Jun. 30, 2014, Liu et al.
U.S. Appl. No. 14/320,413, filed Jun. 30, 2014, Liu et al.
U.S. Appl. No. 14/874,123, filed Oct. 2, 2015, Liu et al.
U.S. Appl. No. 14/911,117, filed Feb. 9, 2016, Liu et al.
U.S. Appl. No. 17/160,329, filed Jan. 27, 2021, Liu et al.
U.S. Appl. No. 15/029,602, filed Apr. 14, 2016, Ritter et al.
U.S. Appl. No. 14/462,163, filed Aug. 18, 2014, Liu et al.
U.S. Appl. No. 14/462,189, filed Aug. 18, 2014, Liu et al.
U.S. Appl. No. 14/916,679, filed Mar. 4, 2016, Liu et al.
U.S. Appl. No. 16/860,639, filed Apr. 28, 2020, Liu et al.
U.S. Appl. No. 14/320,498, filed Jun. 30, 2014, Liu et al.
U.S. Appl. No. 14/320,467, filed Jun. 30, 2014, Liu et al.
U.S. Appl. No. 14/916,681, filed Mar. 4, 2016, Liu et al.
U.S. Appl. No. 17/103,233, filed Nov. 24, 2020, Liu et al.
U.S. Appl. No. 14/326,329, filed Jul. 8, 2014, Liu et al.
U.S. Appl. No. 14/326,340, filed Jul. 8, 2014, Liu et al.
U.S. Appl. No. 14/326,361, filed Jul. 8, 2014, Liu et al.
U.S. Appl. No. 14/916,683, filed Mar. 4, 2016, Liu et al.
U.S. Appl. No. 16/796,323, filed Feb. 20, 2020, Liu et al.
U.S. Appl. No. 17/688,416, filed Mar. 7, 2022, Liu et al.
U.S. Appl. No. 14/325,815, filed Jul. 8, 2014, Liu et al.
U.S. Appl. No. 14/326,109, filed Jul. 8, 2014, Liu et al.
U.S. Appl. No. 14/326,140, filed Jul. 8, 2014, Liu et al.
U.S. Appl. No. 14/326,269, filed Jul. 8, 2014, Liu et al.
U.S. Appl. No. 14/326,290, filed Jul. 8, 2014, Liu et al.
U.S. Appl. No. 14/326,318, filed Jul. 8, 2014, Liu et al.
U.S. Appl. No. 14/326,303, filed Jul. 8, 2014, Liu et al.
U.S. Appl. No. 15/103,608, filed Jun. 10, 2016, Liu et al.
U.S. Appl. No. 16/374,634, filed Apr. 3, 2019, Liu et al.
U.S. Appl. No. 17/408,306, filed Aug. 20, 2021, Liu et al.
U.S. Appl. No. 15/329,925, filed Jan. 27, 2017, Liu et al.
U.S. Appl. No. 16/132,276, filed Sep. 14, 2018, Liu et al.
U.S. Appl. No. 16/888,646, filed May 29, 2020, Liu et al.
U.S. Appl. No. 14/529,010, filed Oct. 30, 2014, Liu et al.
U.S. Appl. No. 15/958,721, filed Apr. 20, 2018, Liu et al.
U.S. Appl. No. 17/130,812, filed Dec. 22, 2020, Liu et al.
U.S. Appl. No. 15/331,852, filed Oct. 22, 2016, Liu et al.
U.S. Appl. No. 15/960,171, filed Apr. 23, 2018, Liu et al.
U.S. Appl. No. 17/527,011, filed Nov. 15, 2021, Liu et al.
U.S. Appl. No. 15/770,076, filed Apr. 20, 2018, Liu et al.
U.S. Appl. No. 16/327,744, filed Feb. 22, 2019, Maianti et al.
U.S. Appl. No. 16/492,548, filed Sep. 9, 2019, Maianti et al.
U.S. Appl. No. 15/784,033, filed Oct. 13, 2017, Liu et al.
U.S. Appl. No. 17/692,925, filed Mar. 11, 2022, Liu et al.
U.S. Appl. No. 16/492,553, filed Sep. 9, 2019, Liu et al.
U.S. Appl. No. 15/934,945, filed Mar. 23, 2018, Liu et al.
U.S. Appl. No. 17/586,688, filed Jan. 27, 2022, Liu et al.
U.S. Appl. No. 16/643,376, filed Feb. 28, 2020, Liu et al.
U.S. Appl. No. 17/700,109, filed Mar. 21, 2022, Liu et al.
U.S. Appl. No. 16/612,988, filed Nov. 12, 2019, Liu et al.
U.S. Appl. No. 16/634,405, filed Jan. 27, 2020, Liu et al.
U.S. Appl. No. 16/976,047, filed Aug. 26, 2020, Liu et al.
U.S. Appl. No. 17/593,020, filed Sep. 3, 2021, Church et al.
PCT/US2020/028568, Jul. 24, 2020, International Search Report and Written Opinion.
PCT/US2020/028568, Oct. 28, 2021, International Preliminary Report on Patentability.
[No Author Listed], Larimar Therapeutics Provides Update on CTI-1601 Clinical Program. Larimar Therapeutics, Inc. Feb. 14, 2022. Accessed Jun. 9, 2025 from <https://investors.larimartx.com/news-releases/news-release-details/larimar-therapeutics-provides-update-cti-1601-clinical-program>. 2 pages.
Abed et al., The Gag protein PEG10 binds to RNA and regulates trophoblast stem cell lineage specification. PLoS One. Apr. 5, 2019;14(4):e0214110. doi: 10.1371/journal.pone.0214110.

(56) References Cited

OTHER PUBLICATIONS

Abifadel et al., Mutations in PCSK9 cause autosomal dominant hypercholesterolemia. Nat Genet. Jun. 2003;34(2):154-6. doi: 10.1038/ng1161.
Addgene Plasmid #42234. pMJ920. 2013. Retrieved Jan. 22, 2025. 3 pages.
Adikusuma et al., Versatile single-step-assembly CRISPR/Cas9 vectors for dual gRNA expression. PLoS One. Dec. 6, 2017;12(12):e0187236. doi: 10.1371/journal.pone.0187236.
Alanis-Lobato et al., Frequent loss of heterozygosity in CRISPR-Cas9-edited early human embryos. Proc Natl Acad Sci U S A. Jun. 1, 2021;118(22):e2004832117. doi: 10.1073/pnas.2004832117. Epub Apr. 9, 2021.
Al-Mahdawi et al., Large Interruptions of GAA Repeat Expansion Mutations in Friedreich Ataxia Are Very Rare. Front Cell Neurosci. Nov. 21, 2018;12:443. doi: 10.3389/fncel.2018.00443.
Anderson et al., pegIT—a web-based design tool for prime editing. Nucleic Acids Res. Jul. 2, 2021;49(W1):W505-W509. doi: 10.1093/nar/gkab427.
Anzalone et al., Programmable deletion, replacement, integration and inversion of large DNA sequences with twin prime editing. Nat Biotechnol. May 2022;40(5):731-740. doi: 10.1038/s41587-021-01133-w. Epub Dec. 9, 2021.
Ashley et al., Retrovirus-like Gag Protein Arc1 Binds RNA and Traffics across Synaptic Boutons. Cell. Jan. 11, 2018;172(1-2):262-274.e11. doi: 10.1016/j.cell.2017.12.022.
Ayala-Ramirez et al., A new autosomal recessive syndrome consisting of posterior microphthalmos, retinitis pigmentosa, foveoschisis, and optic disc drusen is caused by a MFRP gene mutation. Mol Vis. Dec. 4, 2006;12:1483-9.
Bandiera et al., Genetic variations creating microRNA target sites in the Fxn 3'-UTR affect frataxin expression in Friedreich ataxia. PLoS One. 2013;8(1):e54791. doi: 10.1371/journal.pone.0054791. Epub Jan. 30, 2013.
Belbellaa et al., High Levels of Frataxin Overexpression Lead to Mitochondrial and Cardiac Toxicity in Mouse Models. Mol Ther Methods Clin Dev. Sep. 1, 2020;19:120-138. doi: 10.1016/j.omtm.2020.08.018.
Bender et al., Receptor-Targeted Nipah Virus Glycoproteins Improve Cell-Type Selective Gene Delivery and Reveal a Preference for Membrane-Proximal Cell Attachment. PLoS Pathog. Jun. 9, 2016;12(6):e1005641. doi: 10.1371/journal.ppat.1005641.
Bernardi et al., Nucleotide sequence at the binding site for coat protein on RNA of bacteriophage R17. Proc Natl Acad Sci U S A. Oct. 1972;69(10):3033-7. doi: 10.1073/pnas.69.10.3033.
Berríos et al., Controllable genome editing with split-engineered base editors. Nat Chem Biol. Dec. 2021;17(12):1262-1270. doi: 10.1038/s41589-021-00880-w. Epub Oct. 18, 2021.
Bidichandani et al., Friedreich Ataxia. Dec. 18, 1998 [updated Apr. 10, 2025]. In: Adam MP, Feldman J, Mirzaa GM, Pagon RA, Wallace SE, Amemiya A, editors. GeneReviews® [Internet]. Seattle (WA): University of Washington, Seattle; 1993-2025. 41 pages.
Bikard et al., Programmable repression and activation of bacterial gene expression using an engineered CRISPR-Cas system. Nucleic Acids Res. Aug. 2013;41(15):7429-37. doi: 10.1093/nar/gkt520. Epub Jun. 12, 2013.
Blum et al., Phage-assisted evolution of botulinum neurotoxin proteases with reprogrammed specificity. Science. Feb. 19, 2021;371(6531):803-810. doi: 10.1126/science.abf5972.
Böck et al., In vivo prime editing of a metabolic liver disease in mice. Sci Transl Med. Mar. 16, 2022;14(636):eabl9238. doi: 10.1126/scitranslmed.abl9238. Epub Mar. 16, 2022. Author Manuscript. 26 pages.
Bolukbasi et al., DNA-binding-domain fusions enhance the targeting range and precision of Cas9. Nat Methods. Dec. 2015;12(12):1150-6. doi: 10.1038/nmeth.3624. Epub Oct. 19, 2015.
Brödel et al., Accelerated evolution of a minimal 63-amino acid dual transcription factor. Sci Adv. Jun. 10, 2020;6(24):eaba2728. doi: 10.1126/sciadv.aba2728.
Bryson et al., Continuous directed evolution of aminoacyl-tRNA synthetases. Nat Chem Biol. Dec. 2017;13(12):1253-1260. doi: 10.1038/nchembio.2474. Epub Oct. 16, 2017. Erratum in: Nat Chem Biol. Jan. 16, 2018;14(2):186. doi: 10.1038/nchembio0218-186.
Cai et al. Targeted genome editing by lentiviral protein transduction of zinc-finger and TAL-effector nucleases. Elife. Apr. 24, 2014;3:e01911. doi: 10.7554/eLife.01911.
Cai et al., Abstract OR021: Targeted Genome Editing by Lentiviral Protein Transduction of ZFN and Cas9 Proteins Abstract, Presented at Proceedings of the ESGCT and NVGCT Collaborative Congress: The Hague. Human Gene Therapy. 2014. 15 pages.
Cai, Protein Transduction Using Lentiviral Vectors for Transposition and Site-directed Gene Editing. Thesis for the degree of Doctor of Philosophy, Aarhus University, Department of Biomedicine. 2014. 74 pages.
Cameron et al., Mapping the genomic landscape of CRISPR-Cas9 cleavage. Nat Methods. Jun. 2017;14(6):600-606 with Erratum. doi: 10.1038/nmeth.4284. Epub May 1, 2017. Erratum in: Nat Methods. Dec. 2023;20(12):2068. doi: 10.1038/s41592-023-02114-4. 8 pages.
Canver et al., BCL11A enhancer dissection by Cas9-mediated in situ saturating mutagenesis. Nature. Nov. 12, 2015;527(7577):192-7. doi: 10.1038/nature15521. Epub Sep. 16, 2015.
Chandler et al., Recombinant Adeno-Associated Viral Integration and Genotoxicity: Insights from Animal Models. Hum Gene Ther. Apr. 2017;28(4):314-322. doi: 10.1089/hum.2017.009.
Chandran et al., Inducible and reversible phenotypes in a novel mouse model of Friedreich's Ataxia. Elife. Dec. 19, 2017;6:e30054. doi: 10.7554/eLife.30054.
Chang et al., Functional characterization of the placental fusogenic membrane protein syncytin. Biol Reprod. Dec. 2004;71(6):1956-62. doi: 10.1095/biolreprod.104.033340. Epub Jul. 21, 2004.
Chelico et al., APOBEC3G Dna deaminase acts processively 3' --> 5' on single-stranded DNA. Nat Struct Mol Biol. May 2006;13(5):392-9. doi: 10.1038/nsmb1086. Epub Apr. 23, 2006.
Chen et al., DNA methylation and demethylation in mammals. J Biol Chem. May 27, 2011;286(21):18347-53. doi: 10.1074/jbc.R110.205286. Epub Mar. 24, 2011.
Chen et al., Targeted activation of diverse CRISPR-Cas systems for mammalian genome editing via proximal CRISPR targeting. Nat Commun. Apr. 7, 2017;8:14958. doi: 10.1038/ncomms14958.
Chester et al., Optimization of apolipoprotein B mRNA editing by APOBEC1 apoenzyme and the role of its auxiliary factor, ACF. RNA. Sep. 2004;10(9):1399-411. doi: 10.1261/rna.7490704. Epub Jul. 23, 2004.
Cho et al., Heritable gene knockout in Caenorhabditis elegans by direct injection of Cas9-sgRNA ribonucleoproteins. Genetics. Nov. 2013;195(3):1177-80. doi: 10.1534/genetics.113.155853. Epub Aug. 26, 2013.
Choi et al., Precise genomic deletions using paired prime editing. Nat Biotechnol. Feb. 2022;40(2):218-226. doi: 10.1038/s41587-021-01025-z. Epub Oct. 14, 2021.
Chow et al., A web tool for the design of prime-editing guide RNAs. Nat Biomed Eng. Feb. 2021;5(2):190-194. doi: 10.1038/s41551-020-00622-8. Epub Sep. 28, 2020.
Chylinski et al., The tracrRNA and Cas9 families of type II CRISPR-Cas immunity systems. RNA Biol. May 2013;10(5):Supplementary Material. doi: 10.4161/rna.24321. Epub Apr. 5, 2013. 12 pages.
Cideciyan, Leber congenital amaurosis due to RPE65 mutations and its treatment with gene therapy. Prog Retin Eye Res. Sep. 2010;29(5):398-427. doi: 10.1016/j.preteyeres.2010.04.002. Epub Apr. 24, 2010.
Cinesi et al., Contracting CAG/CTG repeats using the CRISPR-Cas9 nickase. Nat Commun. Nov. 9, 2016;7:13272. doi: 10.1038/ncomms13272. Erratum in: Nat Commun. Oct. 17, 2024;15(1):8951. doi: 10.1038/s41467-024-52719-2.
Clark et al., Expansion of GAA triplet repeats in the human genome: unique origin of the FRDA mutation at the center of an Alu. Genomics. Mar. 2004;83(3):373-83. doi: 10.1016/j.ygeno.2003.09.001.
Cnop et al., Diabetes in Friedreich ataxia. J Neurochem. Aug. 2013;126 Suppl 1:94-102. doi: 10.1111/jnc.12216.

(56) References Cited

OTHER PUBLICATIONS

Coey, Sumoylation of thymine DNA glycosylase occurs efficiently and weakens DNA binding but does not regulate enzymatic turnover. Dissertation. 2017. 178 pages.

Cohen et al., Low LDL cholesterol in individuals of African descent resulting from frequent nonsense mutations in PCSK9. Nat Genet. Feb. 2005;37(2):161-5. doi: 10.1038/ng1509. Epub Jan. 16, 2005. Erratum in: Nat Genet. Mar. 2005;37(3):328.

Cohen et al., Sequence variations in PCSK9, low LDL, and protection against coronary heart disease. N Engl J Med. Mar. 23, 2006;354(12):1264-72. doi: 10.1056/NEJMoa054013.

Contreras-Galindo et al., Human Endogenous Retrovirus Type K (HERV-K) Particles Package and Transmit HERV-K-Related Sequences. J Virol. Jul. 2015;89(14):7187-201. doi: 10.1128/JVI.00544-15. Epub Apr. 29, 2015.

Cook et al., Friedreich's ataxia: clinical features, pathogenesis and management. Br Med Bull. Dec. 1, 2017;124(1):19-30. doi: 10.1093/bmb/ldx034.

Coquin, Characterization of lentiviral vectors pseudotyped with murine syncytins and their cellular targets in vitro and in vivo. Thesis. University of Évry Val d'Essonne. Defense on Dec. 10, 2019. 238 pages.

Cuella-Martin et al., Functional interrogation of DNA damage response variants with base editing screens. Cell. Feb. 18, 2021;184(4):1081-1097.e19. doi: 10.1016/j.cell.2021.01.041.

Dabrowska et al., Precise Excision of the CAG Tract from the Huntingtin Gene by Cas9 Nickases. Front Neurosci. Feb. 26, 2018;12:75. doi: 10.3389/fnins.2018.00075.

De Biase et al., Progressive GAA expansions in dorsal root ganglia of Friedreich's ataxia patients. Ann Neurol. Jan. 2007;61(1):55-60. doi: 10.1002/ana.21052.

Debenedictis et al., Measuring the tolerance of the genetic code to altered codon size. Elife. Mar. 16, 2022;11:e76941. doi: 10.7554/eLife.76941.

Debenedictis et al., Multiplex suppression of four quadruplet codons via tRNA directed evolution. Nat Commun. Sep. 29, 2021;12(1):5706. doi: 10.1038/s41467-021-25948-y.

Debenedictis et al., Systematic molecular evolution enables robust biomolecule discovery. Nat Methods. Jan. 2022;19(1):55-64. doi: 10.1038/s41592-021-01348-4. Epub Dec. 30, 2021.

Delatycki et al., Friedreich ataxia-pathogenesis and implications for therapies. Neurobiol Dis. Dec. 2019;132:104606. doi: 10.1016/j.nbd.2019.104606. Epub Sep. 5, 2019.

Den Hollander et al., Leber congenital amaurosis: genes, proteins and disease mechanisms. Prog Retin Eye Res. Jul. 2008;27(4):391-419. doi: 10.1016/j.preteyeres.2008.05.003. Epub Jun. 1, 2008.

Dong et al., Lentiviral Vectors for Delivery of Gene-Editing Systems Based on CRISPR/Cas: Current State and Perspectives. Viruses. Jul. 1, 2021;13(7):1288. doi: 10.3390/v13071288.

Enache et al., Cas9 activates the p53 pathway and selects for p53-inactivating mutations. Nat Genet. Jul. 2020;52(7):662-668. doi: 10.1038/s41588-020-0623-4. Epub May 18, 2020. Erratum in: Nat Genet. Jul. 2020;52(7):748-749. doi: 10.1038/s41588-020-0663-9.

Esashi et al., Stabilization of RAD51 nucleoprotein filaments by the C-terminal region of BRCA2. Nat Struct Mol Biol. Jun. 2007;14(6):468-74. doi: 10.1038/nsmb1245. Epub May 21, 2007.

Farhy-Tselnicker et al., Astrocytes, neurons, synapses: a tripartite view on cortical circuit development. Neural Dev. May 1, 2018;13(1):7. doi: 10.1186/s13064-018-0104-y.

Fehér et al., Characterization of the murine leukemia virus protease and its comparison with the human immunodeficiency virus type 1 protease. J Gen Virol. May 2006;87(Pt 5):1321-1330. doi: 10.1099/vir.0.81382-0.

Fisher et al., Transduction with recombinant adeno-associated virus for gene therapy is limited by leading-strand synthesis. J Virol. Jan. 1996;70(1):520-32. doi: 10.1128/JVI.70.1.520-532.1996.

Fishman-Lobell et al., Two alternative pathways of double-strand break repair that are kinetically separable and independently modulated. Mol Cell Biol. Mar. 1992;12(3):1292-303. doi: 10.1128/mcb.12.3.1292-1303.1992.

Fitzgerald et al., Effect of an RNA interference drug on the synthesis of proprotein convertase subtilisin/kexin type 9 (PCSK9) and the concentration of serum LDL cholesterol in healthy volunteers: a randomised, single-blind, placebo-controlled, phase 1 trial. Lancet. Jan. 4, 2014;383(9911):60-68. doi: 10.1016/S0140-6736(13)61914-5. Epub Oct. 3, 2013.

Fonfara et al., Phylogeny of Cas9 determines functional exchangeability of dual-RNA and Cas9 among orthologous type II CRISPR-Cas systems. Nucleic Acids Res. Feb. 2014;42(4):2577-90. doi: 10.1093/nar/gkt1074. Epub Nov. 22, 2013. Supplementary Information. 67 pages.

Gaidukov et al., A multi-landing pad DNA integration platform for mammalian cell engineering. Nucleic Acids Res. May 4, 2018;46(8):4072-4086. doi: 10.1093/nar/gky216.

Gao et al., Delineation of the Exact Transcription Termination Signal for Type 3 Polymerase III. Mol Ther Nucleic Acids. Mar. 2, 2018;10:36-44. doi: 10.1016/j.omtn.2017.11.006. Epub Nov. 21, 2017.

Gao et al., Genomic and Transcriptomic Analyses of Prime Editing Guide RNA-Independent Off-Target Effects by Prime Editors. CRISPR J. 2022;5(2):276-93. doi: 10.1089/crispr.2021.0080.

Garnier et al., WW domains and retrovirus budding. Nature. Jun. 27, 1996;381(6585):744-5. doi: 10.1038/381744a0.

GenBank Accession No. AAH57574.1 2009. 2 pages.

Geurts et al., Evaluating CRISPR-based prime editing for cancer modeling and CFTR repair in organoids. Life Sci Alliance. Aug. 9, 2021;4(10):e202000940. doi: 10.26508/lsa.202000940.

Giannoukos et al., UDiTaS™, a genome editing detection method for indels and genome rearrangements. BMC Genomics. Mar. 21, 2018;19(1):212. doi: 10.1186/s12864-018-4561-9.

Golczak et al., Importance of membrane structural integrity for RPE65 retinoid isomerization activity. J Biol Chem. Mar. 26, 2010;285(13):9667-9682. doi: 10.1074/jbc.M109.063941. Epub Jan. 25, 2010.

Greene et al., Repeat-induced epigenetic changes in intron 1 of the frataxin gene and its consequences in Friedreich ataxia. Nucleic Acids Res. 2007;35(10):3383-90. doi: 10.1093/nar/gkm271. Epub May 3, 2007.

Grimm et al., Helper virus-free, optically controllable, and two-plasmid-based production of adeno-associated virus vectors of serotypes 1 to 6. Mol Ther. Jun. 2003;7(6):839-50. doi: 10.1016/s1525-0016(03)00095-9.

Grimm et al., Novel tools for production and purification of recombinant adenoassociated virus vectors. Hum Gene Ther. Dec. 10, 1998;9(18):2745-60. doi: 10.1089/hum.1998.9.18-2745.

Grünewald et al., A dual-deaminase CRISPR base editor enables concurrent adenine and cytosine editing. Nat Biotechnol. Jul. 2020;38(7):861-864. doi: 10.1038/s41587-020-0535-y. Epub Jun. 1, 2020.

Grünewald et al., CRISPR DNA base editors with reduced RNA off-target and self-editing activities. Nat Biotechnol. Sep. 2019;37(9):1041-1048. doi: 10.1038/s41587-019-0236-6. Epub Sep. 2, 2019.

Gusel'Nikova et al., NeuN as a Neuronal Nuclear Antigen and Neuron Differentiation Marker. Acta Naturae. Apr.-Jun. 2015;7(2):42-7.

Habib et al., Comprehensive analysis of prime editing outcomes in human embryonic stem cells. Nucleic Acids Res. Jan. 25, 2022;50(2):1187-1197. doi: 10.1093/nar/gkab1295.

Hamilton et al., Knocking out barriers to engineered cell activity. Science. Feb. 28, 2020;367(6481):976-977. doi: 10.1126/science.aba9844. Epub Feb. 6, 2020.

Heins et al., Designing Automated, High-throughput, Continuous Cell Growth Experiments Using eVOLVER. J Vis Exp. May 19, 2019;(147):10.3791/59652. doi: 10.3791/59652.

Heintze et al., A CRISPR CASe for high-throughput silencing. Front Genet. Oct. 7, 2013;4:193. doi: 10.3389/fgene.2013.00193.

(56) References Cited

OTHER PUBLICATIONS

Hooper et al., The C679X mutation in PCSK9 is present and lowers blood cholesterol in a Southern African population. Atherosclerosis. Aug. 2007;193(2):445-8. doi: 10.1016/j.atherosclerosis.2006.08.039. Epub Sep. 20, 2006.
Hu et al., A compact Cas9 ortholog from *Staphylococcus auricularis* (SauriCas9) expands the DNA targeting scope. PLoS Biol. Mar. 30, 2020;18(3):e3000686. doi: 10.1371/journal.pbio.3000686.
Hubbard et al., Continuous directed evolution of DNA-binding proteins to improve TALEN specificity. Nat Methods. Oct. 2015;12(10):939-42. doi: 10.1038/nmeth.3515. Epub Aug. 10, 2015.
Huichalaf et al., In vivo overexpression of frataxin causes toxicity mediated by iron-sulfur cluster deficiency. Mol Ther Methods Clin Dev. Feb. 7, 2022;24:367-378. doi: 10.1016/j.omtm.2022.02.002.
Hwang et al., PE-Designer and PE-Analyzer: web-based design and analysis tools for CRISPR prime editing. Nucleic Acids Res. Jul. 2, 2021;49(W1):W499-W504. doi: 10.1093/nar/gkab319.
Jacobs et al., DNA glycosylases: in DNA repair and beyond. Chromosoma. Feb. 2012;121(1):1-20. doi: 10.1007/s00412-011-0347-4. Epub Nov. 3, 2011. 20 pages.
Jang et al., Application of prime editing to the correction of mutations and phenotypes in adult mice with liver and eye diseases. Nat Biomed Eng. Feb. 2022;6(2):181-194. doi: 10.1038/s41551-021-00788-9. Epub Aug. 26, 2021.
Jang et al., High-purity production and precise editing of DNA base editing ribonucleoproteins. Sci Adv. Aug. 27, 2021;7(35):eabg2661. doi: 10.1126/sciadv.abg2661.
Jeong et al., Adenine base editor engineering reduces editing of bystander cytosines. Nat Biotechnol. Nov. 2021;39(11):1426-1433. doi: 10.1038/s41587-021-00943-2. Epub Jul. 1, 2021.
Jeong et al., Construction of non-canonical PAM-targeting adenosine base editors by restriction enzyme-free DNA cloning using CRISPR-Cas9. Sci Rep. Mar. 20, 2019;9(1):4939. doi: 10.1038/s41598-019-41356-1.
Jiang et al., Deletion and replacement of long genomic sequences using prime editing. Nat Biotechnol. Feb. 2022;40(2):227-234. doi: 10.1038/s41587-021-01026-y. Epub Oct. 14, 2021.
Jin et al., Genome-wide specificity of prime editors in plants. Nat Biotechnol. Oct. 2021;39(10):1292-1299. doi: 10.1038/s41587-021-00891-x. Epub Apr. 15, 2021.
Jinek et al., A programmable dual-RNA-guided DNA endonuclease in adaptive bacterial immunity. Science. Aug. 17, 2012;337(6096):Supplementary Material. doi: 10.1126/science.1225829. Epub Jun. 28, 2012. 37 pages.
Jiralerspong et al., Frataxin shows developmentally regulated tissue-specific expression in the mouse embryo. Neurobiol Dis. 1997;4(2):103-13. doi: 10.1006/nbdi.1997.0139.
Jo et al., Therapeutic adenine base editing corrects nonsense mutation and improves visual function in a mouse model of Leber congenital amaurosis. bioRxiv preprint. Jan. 8, 2021. doi: 10.1101/2021.01.07.425822. 19 pages.
Johnson et al., Mass spectrometry analysis reveals differences in the host cell protein species found in pseudotyped lentiviral vectors. Biologicals. Mar. 2018;52:59-66. doi: 10.1016/j.biologicals.2017.12.005. Epub Feb. 1, 2018.
Johnson et al., Therapeutic landscape for Batten disease: current treatments and future prospects. Nat Rev Neurol. Mar. 2019;15(3):161-178. doi: 10.1038/s41582-019-0138-8.
Johnson, Origins and evolutionary consequences of ancient endogenous retroviruses. Nat Rev Microbiol. Jun. 2019;17(6):355-370. doi: 10.1038/s41579-019-0189-2.
Johnston et al., Continuous bioactivity-dependent evolution of an antibiotic biosynthetic pathway. Nat Commun. Aug. 21, 2020;11(1):4202. doi: 10.1038/s41467-020-18018-2.
Jones et al., Phage-Assisted Continuous Evolution and Selection of Enzymes for Chemical Synthesis. ACS Cent Sci. Sep. 22, 2021;7(9):1581-1590. doi: 10.1021/acscentsci.1c00811. Epub Sep. 13, 2021.
Jumper et al., Highly accurate protein structure prediction with AlphaFold. Nature. Aug. 2021;596(7873):583-589. doi: 10.1038/s41586-021-03819-2. Epub Jul. 15, 2021.
Kacher et al., Propensity for somatic expansion increases over the course of life in Huntington disease. Elife. May 13, 2021;10:e64674. doi: 10.7554/eLife.64674.
Kameya et al., Mfrp, a gene encoding a frizzled related protein, is mutated in the mouse retinal degeneration 6. Hum Mol Genet. Aug. 1, 2002;11(16):1879-86. doi: 10.1093/hmg/11.16.1879.
Kantor et al., CRISPR-Cas9 DNA Base-Editing and Prime-Editing. Int J Mol Sci. Aug. 28, 2020;21(17):6240. doi: 10.3390/ijms21176240.
Karvelis et al., PAM recognition by miniature CRISPR-Cas12f nucleases triggers programmable double-stranded DNA target cleavage. Nucleic Acids Res. May 21, 2020;48(9):5016-5023. doi: 10.1093/nar/gkaa208.
Katoh et al., Exploitation of the interaction of measles virus fusogenic envelope proteins with the surface receptor CD46 on human cells for microcell-mediated chromosome transfer. BMC Biotechnol. May 6, 2010;10:37. doi: 10.1186/1472-6750-10-37.
Kawakami, K., Tol2: a versatile gene transfer vector in vertebrates. Genome Biol. 2007;8 Suppl 1(Suppl 1):S7. doi: 10.1186/gb-2007-8-s1-s7.
Kern et al., Identification of a heparin-binding motif on adeno-associated virus type 2 capsids. J Virol. Oct. 2003;77(20):11072-81. doi: 10.1128/jvi.77.20.11072-11081.2003.
Khristich et al., Large-scale contractions of Friedreich's ataxia GAA repeats in yeast occur during DNA replication due to their triplex-forming ability. Proc Natl Acad Sci U S A. Jan. 21, 2020;117(3):1628-1637. doi: 10.1073/pnas.1913416117. Epub Jan. 7, 2020.
Kim et al., Unbiased investigation of specificities of prime editing systems in human cells. Nucleic Acids Res. Oct. 9, 2020;48(18):10576-10589. doi: 10.1093/nar/gkaa764.
Kleinstiver et al., Broadening the targeting range of *Staphylococcus aureus* CRISPR-Cas9 by modifying PAM recognition. Nat Biotechnol. Dec. 2015;33(12):1293-1298. doi: 10.1038/nbt.3404. Epub Nov. 2, 2015. Author Manuscript, 14 pages.
Kneissl et al., Measles virus glycoprotein-based lentiviral targeting vectors that avoid neutralizing antibodies. PLoS One. 2012;7(10):e46667. doi: 10.1371/journal.pone.0046667. Epub Oct. 10, 2012.
Kronenberg et al., A conformational change in the adeno-associated virus type 2 capsid leads to the exposure of hidden VP1 N termini. J Virol. May 2005;79(9):5296-303. doi: 10.1128/JVI.79.9.5296-5303.2005.
Kulcsár et al., Blackjack mutations improve the on-target activities of increased fidelity variants of SpCas9 with 5'G-extended sgRNAs. Nat Commun. Mar. 6, 2020;11(1):1223. doi: 10.1038/s41467-020-15021-5.
Lam et al., Improved cytosine base editors generated from TadA variants. Nat Biotechnol. May 2023;41(5):686-697. doi: 10.1038/s41587-022-01611-9. Epub Jan. 9, 2023.
Lau et al., In vivo epigenome editing and transcriptional modulation using CRISPR technology. Transgenic Res. Dec. 2018;27(6):489-509. doi: 10.1007/s11248-018-0096-8. Epub Oct. 4, 2018.
Lazaropoulos et al., Frataxin levels in peripheral tissue in Friedreich ataxia. Ann Clin Transl Neurol. Aug. 2015;2(8):831-42. doi: 10.1002/acn3.225. Epub Jul. 1, 2015.
Lazzarotto et al., CHANGE-seq reveals genetic and epigenetic effects on CRISPR-Cas9 genome-wide activity. Nat Biotechnol. Nov. 2020;38(11):1317-1327. doi: 10.1038/s41587-020-0555-7. Epub Jun. 15, 2020.
Lebar et al., A tunable orthogonal coiled-coil interaction toolbox for engineering mammalian cells. Nat Chem Biol. May 2020;16(5):513-519. doi: 10.1038/s41589-019-0443-y. Epub Jan. 6, 2020.
Lee et al., Reconstitution of an infectious human endogenous retrovirus. PLoS Pathog. Jan. 2007;3(1):e10. doi: 10.1371/journal.ppat.0030010.
Leenay et al., Identifying and Visualizing Functional PAM Diversity across CRISPR-Cas Systems. Mol Cell. Apr. 7, 2016;62(1):137-47. doi: 10.1016/j.molcel.2016.02.031. Epub Mar. 31, 2016.

(56) References Cited

OTHER PUBLICATIONS

Leibowitz et al., Chromothripsis as an on-target consequence of CRISPR-Cas9 genome editing. Nat Genet. Jun. 2021;53(6):895-905. doi: 10.1038/s41588-021-00838-7. Epub Apr. 12, 2021.
Leibundgut-Landmann et al., Mini-review: Specificity and expression of CIITA, the master regulator of MHC class II genes. Eur J Immunol. Jun. 2004;34(6):1513-25. doi: 10.1002/eji.200424964.
Li et al., A dominant-negative form of mouse SOX2 induces trophectoderm differentiation and progressive polyploidy in mouse embryonic stem cells. J Biol Chem. Jul. 6, 2007;282(27):19481-92. doi: 10.1074/jbc.M702056200. Epub May 15, 2007.
Li et al., Base-Resolution Mapping Reveals Distinct m1A Methylome in Nuclear- and Mitochondrial-Encoded Transcripts. Mol Cell. Dec. 7, 2017;68(5):993-1005.e9. doi: 10.1016/j.molcel.2017.10.019. Epub Nov. 5, 2017.
Li et al., Excision of Expanded GAA Repeats Alleviates the Molecular Phenotype of Friedreich's Ataxia. Mol Ther. Jun. 2015;23(6):1055-1065. doi: 10.1038/mt.2015.41. Epub Mar. 11, 2015.
Li et al., Excision of the expanded GAA repeats corrects cardiomyopathy phenotypes of iPSC-derived Friedreich's ataxia cardiomyocytes. Stem Cell Res. Oct. 2019;40:101529. doi: 10.1016/j.scr.2019.101529. Epub Aug. 7, 2019.
Li et al., Targeted, random mutagenesis of plant genes with dual cytosine and adenine base editors. Nat Biotechnol. Jul. 2020;38(7):875-882. doi: 10.1038/s41587-019-0393-7. Epub Jan. 13, 2020.
Lim et al., Specific insertions of zinc finger domains into Gag-Pol yield engineered retroviral vectors with selective integration properties. Proc Natl Acad Sci U S A. Jul. 13, 2010;107(28):12475-80. doi: 10.1073/pnas.1001402107. Epub Jun. 28, 2010.
Lin et al., CRISPR base editor treats premature-aging syndrome. Signal Transduct Target Ther. Apr. 16, 2021;6(1):158. doi: 10.1038/s41392-021-00576-6.
Lin et al., Modeling a cataract disorder in mice with prime editing. Mol Ther Nucleic Acids. Jul. 2, 2021;25:494-501. doi: 10.1016/j.omtn.2021.06.020.
Liu et al., A split prime editor with untethered reverse transcriptase and circular RNA template. Nat Biotechnol. Sep. 2022;40(9):1388-1393. doi: 10.1038/s41587-022-01255-9. Epub Apr. 4, 2022.
Liu et al., Delivery methods for site-specific nucleases: Achieving the full potential of therapeutic gene editing. J Control Release. Dec. 28, 2016;244(Pt A):83-97. doi: 10.1016/j.jconrel.2016.11.014. Epub Nov. 16, 2016.
Liu et al., DNA base excision repair: a mechanism of trinucleotide repeat expansion. Trends Biochem Sci. Apr. 2012;37(4):162-72. doi: 10.1016/j.tibs.2011.12.002. Epub Jan. 27, 2012.
Liu et al., Efficient and high-fidelity base editor with expanded PAM compatibility for cytidine dinucleotide. Sci China Life Sci. Aug. 2021;64(8):1355-1367. doi: 10.1007/s11427-020-1775-2. Epub Jan. 6, 2021.
Liu et al., Efficient generation of mouse models with the prime editing system. Cell Discov. Apr. 28, 2020;6:27. doi: 10.1038/s41421-020-0165-z.
Liu et al., Improved prime editors enable pathogenic allele correction and cancer modelling in adult mice. Nat Commun. Apr. 9, 2021;12(1):2121. doi: 10.1038/s41467-021-22295-w.
Long et al., Somatic instability of the expanded GAA repeats in Friedreich's ataxia. PLoS One. Dec. 19, 2017;12(12):e0189990. doi: 10.1371/journal.pone.0189990.
Loughrey et al., Non-liver mRNA Delivery. Acc Chem Res. Jan. 4, 2022;55(1):13-23. doi: 10.1021/acs.accounts.1c00601. Epub Dec. 3, 2021.
Lu et al., Lentiviral Capsid-Mediated *Streptococcus pyogenes* Cas9 Ribonucleoprotein Delivery for Efficient and Safe Multiplex Genome Editing. CRISPR J. Dec. 2021;4(6):914-928. doi: 10.1089/crispr.2020.0106. Epub Mar. 16, 2021.
Ma et al., Generation of pathogenic TPP1 mutations in human stem cells as a model for neuronal ceroid lipofuscinosis type 2 disease. Stem Cell Res. May 2021;53:102323. doi: 10.1016/j.scr.2021.102323. Epub Apr. 6, 2021.
Ma et al., Pol III Promoters to Express Small RNAs: Delineation of Transcription Initiation. Mol Ther Nucleic Acids. May 6, 2014;3(5):e161. doi: 10.1038/mtna.2014.12.
Martín et al., Envelope-targeted retrovirus vectors transduce melanoma xenografts but not spleen or liver. Mol Ther. Mar. 2002;5(3):269-74. doi: 10.1006/mthe.2002.0550.
Mason et al., Coiled coil domains: stability, specificity, and biological implications. Chembiochem. Feb. 6, 2004;5(2):170-6. doi: 10.1002/cbic.200300781.
Massey et al., The central role of DNA damage and repair in CAG repeat diseases. Dis Model Mech. Jan. 30, 2018;11(1):dmm031930. doi: 10.1242/dmm.031930.
Mazzara et al., Frataxin gene editing rescues Friedreich's ataxia pathology in dorsal root ganglia organoid-derived sensory neurons. Nat Commun. Aug. 21, 2020;11(1):4178. doi: 10.1038/s41467-020-17954-3.
Mercuri et al., Nusinersen versus Sham Control in Later-Onset Spinal Muscular Atrophy. N Engl J Med. Feb. 15, 2018;378(7):625-635. doi: 10.1056/NEJMoa1710504.
Meunier et al., Drug-Induced Liver Injury: Biomarkers, Requirements, Candidates, and Validation. Front Pharmacol. Dec. 11, 2019;10:1482. doi: 10.3389/fphar.2019.01482.
Miller et al., Cell-surface receptors for retroviruses and implications for gene transfer. Proc Natl Acad Sci U S A. Oct. 15, 1996;93(21):11407-13. doi: 10.1073/pnas.93.21.11407.
Mingozzi, F., Immunogenicity: A Matter of Sensitivity. Mol Ther. Oct. 3, 2018;26(10):2335-2336. doi: 10.1016/j.ymthe.2018.09.001. Epub Sep. 18, 2018.
Monteys et al., CRISPR/Cas9 Editing of the Mutant Huntingtin Allele In Vitro and In Vivo. Mol Ther. Jan. 4, 2017;25(1):12-23. doi: 10.1016/j.ymthe.2016.11.010. Epub Jan. 4, 2017.
Morrison et al., The developing toolkit of continuous directed evolution. Nat Chem Biol. Jun. 2020;16(6):610-619. doi: 10.1038/s41589-020-0532-y. Epub May 22, 2020.
Moullier et al., International efforts for recombinant adeno-associated viral vector reference standards. Mol Ther. Jul. 2008;16(7):1185-8. doi: 10.1038/mt.2008.125.
Mullally et al., 5' modifications to CRISPR-Cas9 gRNA can change the dynamics and size of R-loops and inhibit DNA cleavage. Nucleic Acids Res. Jul. 9, 2020;48(12):6811-6823. doi: 10.1093/nar/gkaa477.
Musunuru et al., In vivo CRISPR base editing of PCSK9 durably lowers cholesterol in primates. Nature. May 2021;593(7859):429-434. doi: 10.1038/s41586-021-03534-y. Epub May 19, 2021.
Naryshkin et al., Motor neuron disease. SMN2 splicing modifiers improve motor function and longevity in mice with spinal muscular atrophy. Science. Aug. 8, 2014;345(6197):688-93. doi: 10.1126/science.1250127.
Nawaz et al., Extracellular Vesicles, Tunneling Nanotubes, and Cellular Interplay: Synergies and Missing Links. Front Mol Biosci. Jul. 18, 2017;4:50. doi: 10.3389/fmolb.2017.00050.
Neil et al., Replication-independent instability of Friedreich's ataxia GAA repeats during chronological aging. Proc Natl Acad Sci U S A. Feb. 2, 2021;118(5):e2013080118. doi: 10.1073/pnas.2013080118.
Nesbitt, Targeted Intracellular Therapeutic Delivery Using Liposomes Formulated with Multifunctional FAST proteins. Electronic Thesis and Dissertation Repository. The University of Western Ontario. 2012. 126 pages.
Nethisinghe et al., Interruptions of the FXN GAA Repeat Tract Delay the Age at Onset of Friedreich's Ataxia in a Location Dependent Manner. Int J Mol Sci. Jul. 13, 2021;22(14):7507. doi: 10.3390/ijms22147507.
Niu et al., Inactivation of porcine endogenous retrovirus in pigs using CRISPR-Cas9. Science. Sep. 22, 2017;357(6357): 1303-1307. doi: 10.1126/science.aan4187. Epub Aug. 10, 2017.
Ohshima et al., A nonpathogenic GAAGGA repeat in the Friedreich gene: implications for pathogenesis. Neurology. Nov. 10, 1999;53(8):1854-7. doi: 10.1212/wnl.53.8.1854.
Oura et al., CAG repeat contraction in a Huntington's Disease mouse model is enabled by gene editing with SpCas9-NG. Commun Biol. Jun. 23, 2021;4(1):771. doi: 10.1038/s42003-021-02304-w.

(56) References Cited

OTHER PUBLICATIONS

Pan et al., Biodistribution and toxicity studies of VSVG-pseudotyped lentiviral vector after intravenous administration in mice with the observation of in vivo transduction of bone marrow. Mol Ther. Jul. 2002;6(1):19-29. doi: 10.1006/mthe.2002.0630.
Pan et al., Identification of a nuclear localization signal in OCT4 and generation of a dominant negative mutant by its ablation. J Biol Chem. Aug. 27, 2004;279(35):37013-20. doi: 10.1074/jbc.M405117200. Epub Jun. 24, 2004.
Pandolfo, M., Friedreich ataxia: new pathways. J Child Neurol. Sep. 2012;27(9):1204-11. doi: 10.1177/0883073812448534. Epub Jun. 29, 2012.
Pang et al., Retinal degeneration 12 (rd12): a new, spontaneously arising mouse model for human Leber congenital amaurosis (LCA). Mol Vis. Feb. 28, 2005;11:152-62.
Park et al., Off-Target Editing by CRISPR-Guided DNA Base Editors. Biochemistry. Sep. 10, 2019;58(36):3727-3734. doi: 10.1021/acs.biochem.9b00573. Epub Aug. 26, 2019.
Park et al., Targeted mutagenesis in mouse cells and embryos using an enhanced prime editor. Genome Biol. Jun. 3, 2021;22(1):170. doi: 10.1186/s13059-021-02389-w.
Parr-Brownlie et al., Lentiviral vectors as tools to understand central nervous system biology in mammalian model organisms. Front Mol Neurosci. May 18, 2015;8:14. doi: 10.3389/fnmol.2015.00014.
Pastuzyn et al., The Neuronal Gene Arc Encodes a Repurposed Retrotransposon Gag Protein that Mediates Intercellular RNA Transfer. Cell. Jan. 11, 2018;172(1-2):275-288.e18. doi: 10.1016/j.cell.2017.12.024. Erratum in: Cell. Mar. 22, 2018;173(1):275. doi: 10.1016/j.cell.2018.03.024.
Pavlov et al., Roles of DNA polymerases in replication, repair, and recombination in eukaryotes. Int Rev Cytol. 2006;255:41-132. doi: 10.1016/S0074-7696(06)55002-8.
Pettersen et al., UCSF Chimera—a visualization system for exploratory research and analysis. J Comput Chem. Oct. 2004;25(13):1605-12. doi: 10.1002/jcc.20084.
Pickar-Oliver et al., The next generation of CRISPR-Cas technologies and applications. Nat Rev Mol Cell Biol. Aug. 2019;20(8):490-507. doi: 10.1038/s41580-019-0131-5.
Pinto et al., Patterns of CAG repeat instability in the central nervous system and periphery in Huntington's disease and in spinocerebellar ataxia type 1. Hum Mol Genet. Aug. 29, 2020;29(15):2551-2567. doi: 10.1093/hmg/ddaa139.
Podbilewicz, Virus and cell fusion mechanisms. Annu Rev Cell Dev Biol. 2014;30:111-39. doi: 10.1146/annurev-cellbio-101512-122422. Epub Jun. 27, 2014.
Porter et al., Therapeutic promise of engineered nonsense suppressor tRNAs. Wiley Interdiscip Rev RNA. Jul. 2021;12(4):e1641. doi: 10.1002/wrna.1641. Epub Feb. 10, 2021.
Punga et al., Long intronic GAA repeats causing Friedreich ataxia impede transcription elongation. EMBO Mol Med. Apr. 2010;2(4):120-9. doi: 10.1002/emmm.201000064.
Puppo et al., Retinal transduction profiles by high-capacity viral vectors. Gene Ther. Oct. 2014;21(10):855-65. doi: 10.1038/gt.2014.57. Epub Jul. 3, 2014.
Puspasari et al., Long range regulation of human FXN gene expression. PLoS One. 2011;6(7):e22001. doi: 10.1371/journal.pone.0022001. Epub Jul. 8, 2011.
Qi et al., Repurposing CRISPR as an RNA-guided platform for sequence-specific control of gene expression. Cell. Feb. 28, 2013;152(5):Supplementary Material. doi: 10.1016/j.cell.2013.02.022. 4 pages.
Qiao et al., Recognizes Structured DNA for Class Switch Recombination. Mol Cell. Aug. 3, 2017;67(3):361-373.e4. doi: 10.1016/j.molcel.2017.06.034. Epub Jul. 27, 2017.
Ramiro et al., Transcription enhances AID-mediated cytidine deamination by exposing single-stranded DNA on the nontemplate strand. Nat Immunol. May 2003;4(5):452-6. doi: 10.1038/ni920.
Rao et al., Large-Scale Phenome-Wide Association Study of PCSK9 Variants Demonstrates Protection Against Ischemic Stroke. Circ Genom Precis Med. Jul. 2018;11(7):e002162. doi: 10.1161/CIRCGEN.118.002162.
Reetz et al., Biological and clinical characteristics of the European Friedreich's Ataxia Consortium for Translational Studies (EFACTS) cohort: a cross-sectional analysis of baseline data. Lancet Neurol. Feb. 2015;14(2):174-82. doi: 10.1016/S1474-4422(14)70321-7. Epub Jan. 5, 2015.
Remington et al., Complete nucleotide sequence of a neuropathogenic variant of Friend murine leukemia virus PVC-211. Nucleic Acids Res. Jun. 25, 1992;20(12):3249. doi: 10.1093/nar/20.12.3249.
Richter et al., Phage-assisted evolution of an adenine base editor with improved Cas domain compatibility and activity. Nat Biotechnol. Jul. 2020;38(7):883-891. doi: 10.1038/s41587-020-0453-z. Epub Mar. 16, 2020. Author Manuscript, 30 pages.
Rocca et al., CRISPR-Cas9 Gene Editing of Hematopoietic Stem Cells from Patients with Friedreich's Ataxia. Mol Ther Methods Clin Dev. May 3, 2020;17:1026-1036. doi: 10.1016/j.omtm.2020.04.018.
Rolfsmeier et al., Stabilizing effects of interruptions on trinucleotide repeat expansions in *Saccharomyces cerevisiae*. Mol Cell Biol. Jan. 2000;20(1):173-80. doi: 10.1128/MCB.20.1.173-180.2000.
Romero et al., Exploring protein fitness landscapes by directed evolution. Nat Rev Mol Cell Biol. Dec. 2009;10(12):866-76. doi: 10.1038/nrm2805.
Roth et al., Phage-Assisted Evolution of Bacillus methanolicus Methanol Dehydrogenase 2. ACS Synth Biol. Apr. 19, 2019;8(4):796-806. doi: 10.1021/acssynbio.8b00481. Epub Mar. 20, 2019.
Rothgangl et al., In vivo adenine base editing of PCSK9 in macaques reduces LDL cholesterol levels. Nat Biotechnol. Aug. 2021;39(8):949-957. doi: 10.1038/s41587-021-00933-4. Epub May 19, 2021.
Rudin et al., Efficient repair of HO-induced chromosomal breaks in *Saccharomyces cerevisiae* by recombination between flanking homologous sequences. Mol Cell Biol. Sep. 1988;8(9):3918-28. doi: 10.1128/mcb.8.9.3918-3928.1988.
Ryan et al., Phosphonoacetate Modifications Enhance the Stability and Editing Yields of Guide RNAs for Cas9 Editors. Biochemistry. Dec. 19, 2023;62(24):3512-3520. doi: 10.1021/acs.biochem.1c00768. Epub Apr. 18, 2022.
Sakamoto et al., GGA*TCC-interrupted triplets in long GAA*TTC repeats inhibit the formation of triplex and sticky DNA structures, alleviate transcription inhibition, and reduce genetic instabilities. J Biol Chem. Jul. 20, 2001;276(29):27178-87. doi: 10.1074/jbc.M101852200. Epub Apr. 26, 2001.
Sakata et al., Base editors for simultaneous introduction of C-to-T and A-to-G mutations. Nat Biotechnol. Jul. 2020;38(7):865-869. doi: 10.1038/s41587-020-0509-0. Epub Jun. 2, 2020. Erratum in: Nat Biotechnol. Jul. 2020;38(7):901. doi: 10.1038/s41587-020-0585-1.
Sanjana et al., Improved vectors and genome-wide libraries for CRISPR screening. Nat Methods. Aug. 2014;11(8):783-784. doi: 10.1038/nmeth.3047.
Santos et al., Friedreich ataxia: molecular mechanisms, redox considerations, and therapeutic opportunities. Antioxid Redox Signal. Sep. 1, 2010;13(5):651-90. doi: 10.1089/ars.2009.3015.
Sapir et al., Viral and developmental cell fusion mechanisms: conservation and divergence. Dev Cell. Jan. 2008;14(1):11-21. doi: 10.1016/j.devcel.2007.12.008.
Schellekens, Bioequivalence and the immunogenicity of biopharmaceuticals. Nat Rev Drug Discov. Jun. 2002;1(6):457-62. doi: 10.1038/nrd818.
Schene et al., Prime editing for functional repair in patient-derived disease models. Nat Commun. Oct. 23, 2020;11(1):5352. doi: 10.1038/s41467-020-19136-7.
Schneider et al., MuLV IN mutants responsive to HDAC inhibitors enhance transcription from unintegrated retroviral DNA. Virology. May 10, 2012;426(2):188-96. doi: 10.1016/j.virol.2012.01.034. Epub Feb. 23, 2012.
Segel et al., Mammalian retrovirus-like protein PEG10 packages its own mRNA and can be pseudotyped for mRNA delivery. Science. Aug. 20, 2021;373(6557):882-889. doi: 10.1126/science.abg6155.

(56) References Cited

OTHER PUBLICATIONS

Semple et al., Brain development in rodents and humans: Identifying benchmarks of maturation and vulnerability to injury across species. Prog Neurobiol. Jul.-Aug. 2013;106-107:1-16. doi: 10.1016/j.pneurobio.2013.04.001. Epub Apr. 11, 2013.
Serreze et al., Major histocompatibility complex class I-deficient NOD-B2mnull mice are diabetes and insulitis resistant. Diabetes. Mar. 1994;43(3):505-9. doi: 10.2337/diab.43.3.505.
Shams et al., Comprehensive deletion landscape of CRISPR-Cas9 identifies minimal RNA-guided DNA-binding modules. Nat Commun. Sep. 27, 2021;12(1):5664. doi: 10.1038/s41467-021-25992-8.
Shen et al., Activation-induced cytidine deaminase (AID) can target both DNA strands when the DNA is supercoiled. Proc Natl Acad Sci U S A. Aug. 31, 2004;101(35):12997-3002. doi: 10.1073/pnas.0404974101. Epub Aug. 24, 2004.
Shin et al., Permanent inactivation of Huntington's disease mutation by personalized allele-specific CRISPR/Cas9. Hum Mol Genet. Oct. 15, 2016;25(20):4566-4576. doi: 10.1093/hmg/ddw286.
Shishkin et al., Large-scale expansions of Friedreich's ataxia GAA repeats in yeast. Mol Cell. Jul. 10, 2009;35(1):82-92. doi: 10.1016/j.molcel.2009.06.017.
Silva et al., Expanded GAA repeats impair FXN gene expression and reposition the FXN locus to the nuclear lamina in single cells. Hum Mol Genet. Jun. 15, 2015;24(12):3457-71. doi: 10.1093/hmg/ddv096. Epub Mar. 26, 2015.
Skipper et al., Delivering the Goods for Genome Engineering and Editing. Hum Gene Ther. Aug. 2015;26(8):486-97. doi: 10.1089/hum.2015.063.
Sodi et al., RPE65-associated inherited retinal diseases: consensus recommendations for eligibility to gene therapy. Orphanet J Rare Dis. Jun. 4, 2021;16(1):257. doi: 10.1186/s13023-021-01868-4.
Song et al., Large-Fragment Deletions Induced by Cas9 Cleavage while Not in the BEs System. Mol Ther Nucleic Acids. Sep. 4, 2020;21:523-526. doi: 10.1016/j.omtn.2020.06.019. Epub Jun. 25, 2020.
Soragni et al., Long intronic GAA*TTC repeats induce epigenetic changes and reporter gene silencing in a molecular model of Friedreich ataxia. Nucleic Acids Res. Nov. 2008;36(19):6056-65. doi: 10.1093/nar/gkn604. Epub Sep. 27, 2008.
Stadtmauer et al., CRISPR-engineered T cells in patients with refractory cancer. Science. Feb. 28, 2020;367(6481):eaba7365. doi: 10.1126/science.aba7365. Epub Feb. 6, 2020.
Stevens et al., Design of a Split Intein with Exceptional Protein Splicing Activity. J Am Chem Soc. Feb. 24, 2016;138(7):2162-5. doi: 10.1021/jacs.5b13528. Epub Feb. 8, 2016. Abstract Only. 1 page.
Swami et al., Somatic expansion of the Huntington's disease CAG repeat in the brain is associated with an earlier age of disease onset. Hum Mol Genet. Aug. 15, 2009;18(16):3039-47. doi: 10.1093/hmg/ddp242. Epub May 23, 2009.
Swiech et al., In vivo interrogation of gene function in the mammalian brain using CRISPR-Cas9. Nat Biotechnol. Jan. 2015;33(1):102-6. doi: 10.1038/nbt.3055. Epub Oct. 19, 2014. Author Manuscript. 22 pages.
Taha et al., Delivery of CRISPR-Cas tools for in vivo genome editing therapy: Trends and challenges. J Control Release. Feb. 2022;342:345-361. doi: 10.1016/j.jconrel.2022.01.013. Epub Jan. 10, 2022.
Takahashi et al., Induction of pluripotent stem cells from mouse embryonic and adult fibroblast cultures by defined factors. Cell. Aug. 25, 2006;126(4):663-76. doi: 10.1016/j.cell.2006.07.024. Epub Aug. 10, 2006.
Taylor, Ocular immune privilege. Eye (Lond). Oct. 2009;23(10):1885-9. doi: 10.1038/eye.2008.382. Epub Jan. 9, 2009.
Thakore et al., Highly specific epigenome editing by CRISPR-Cas9 repressors for silencing of distal regulatory elements. Nat Methods. Dec. 2015;12(12):1143-9. doi: 10.1038/nmeth.3630. Epub Oct. 26, 2015.
Thorne et al., In vivo diffusion analysis with quantum dots and dextrans predicts the width of brain extracellular space. Proc Natl Acad Sci U S A. Apr. 4, 2006;103(14):5567-72. doi: 10.1073/pnas.0509425103. Epub Mar. 27, 2006.
Tokuriki et al., Stability effects of mutations and protein evolvability. Curr Opin Struct Biol. Oct. 2009;19(5):596-604. doi: 10.1016/j.sbi.2009.08.003. Epub Sep. 16, 2009.
Tözsér, Comparative studies on retroviral proteases: substrate specificity. Viruses. Jan. 2010;2(1):147-165. doi: 10.3390/v2010147. Epub Jan. 14, 2010.
Turchiano et al., Quantitative evaluation of chromosomal rearrangements in gene-edited human stem cells by CAST-Seq. Cell Stem Cell. Jun. 3, 2021;28(6):1136-1147.e5. doi: 10.1016/j.stem.2021.02.002. Epub Feb. 23, 2021.
Urano et al., Substitution of the myristoylation signal of human immunodeficiency virus type 1 Pr55Gag with the phospholipase C-deltal pleckstrin homology domain results in infectious pseudovirion production. J Gen Virol. Dec. 2008;89(Pt 12):3144-3149. doi: 10.1099/vir.0.2008/004820-0.
Van Essen et al., CRISPR-Cas Gene Perturbation and Editing in Human Induced Pluripotent Stem Cells. CRISPR J. Oct. 2021;4(5):634-655. doi: 10.1089/crispr.2021.0063. Epub Sep. 28, 2021.
Voisset et al., Phylogeny of a novel family of human endogenous retrovirus sequences, HERV-W, in humans and other primates. AIDS Res Hum Retroviruses. Nov. 20, 1999;15(17):1529-33. doi: 10.1089/088922299309810.
Wang et al., Characterization of an MPS I-H knock-in mouse that carries a nonsense mutation analogous to the human IDUA-W402X mutation. Mol Genet Metab. Jan. 2010;99(1):62-71. doi: 10.1016/j.ymgme.2009.08.002. Erratum in: Mol Genet Metab. Apr. 2010;99(4):439.
Wang et al., Efficient base editing in methylated regions with a human APOBEC3A-Cas9 fusion. Nat Biotechnol. Nov. 2018;36(10):946-949. doi: 10.1038/nbt.4198. Epub Aug. 20, 2018.
Wang et al., Influence of the polyanion on the physico-chemical properties and biological activities of polyanion/DNA/polycation ternary polyplexes. Acta Biomater. Aug. 2012;8(8):3014-26. doi: 10.1016/j.actbio.2012.04.034. Epub Apr. 27, 2012.
Webber et al., Highly efficient multiplex human T cell engineering without double-strand breaks using Cas9 base editors. Nat Commun. Nov. 19, 2019;10(1):5222. doi: 10.1038/s41467-019-13007-6. Erratum in: Nat Commun. Dec. 6, 2019;10(1):5659. doi: 10.1038/s41467-019-13778-y.
Wheeler et al., Proteomics analysis of cellular components in lentiviral vector production using Gel-LC-MS/MS. Proteomics Clin Appl. Feb. 2007;1(2):224-30. doi: 10.1002/prca.200600522. Epub Jan. 22, 2007.
Worgall et al., Treatment of late infantile neuronal ceroid lipofuscinosis by CNS administration of a serotype 2 adeno-associated virus expressing CLN2 cDNA. Hum Gene Ther. May 2008;19(5):463-74. doi: 10.1089/hum.2008.022.
Wu et al., Effect of genome size on AAV vector packaging. Mol Ther. Jan. 2010;18(1):80-6. doi: 10.1038/mt.2009.255. Epub Nov. 10, 2009.
Wu et al., Highly efficient therapeutic gene editing of human hematopoietic stem cells. Nat Med. May 2019;25(5):776-783. doi: 10.1038/s41591-019-0401-y. Epub Mar. 25, 2019.
Xie et al., ACBE, a new base editor for simultaneous C-to-T and A-to-G substitutions in mammalian systems. BMC Biol. Sep. 23, 2020;18(1):131. doi: 10.1186/s12915-020-00866-5.
Xu et al., Cas9-based tools for targeted genome editing and transcriptional control. Appl Environ Microbiol. Mar. 2014;80(5):1544-52. doi: 10.1128/AEM.03786-13. Epub Jan. 3, 2014.
Xu et al., Engineered miniature CRISPR-Cas system for mammalian genome regulation and editing. Mol Cell. Oct. 21, 2021;81(20):4333-4345.e4. doi: 10.1016/j.molcel.2021.08.008. Epub Sep. 3, 2021.
Xu et al., High-throughput mapping of a whole rhesus monkey brain at micrometer resolution. Nat Biotechnol. Dec. 2021;39(12):1521-1528. doi: 10.1038/s41587-021-00986-5. Epub Jul. 26, 2021.
Xu et al., Sequence and structural analyses of nuclear export signals in the NESdb database. Mol Biol Cell. Sep. 2012;23(18):3677-93. doi: 10.1091/mbc.E12-01-0046. Epub Jul. 25, 2012.
Yang et al., CRISPR/Cas9-mediated gene editing ameliorates neurotoxicity in mouse model of Huntington's disease. J Clin Invest. Jun. 30, 2017;127(7):2719-2724. doi: 10.1172/JCI92087. Epub Jun. 19, 2017.

(56) References Cited

OTHER PUBLICATIONS

Yang et al., Time-dependent maturation of cationic liposome-DNA complex for serum resistance. Gene Ther. Mar. 1998;5(3):380-7. doi: 10.1038/sj.gt.3300596.
Zeng et al., Therapeutic base editing of human hematopoietic stem cells. Nat Med. Apr. 2020;26(4):535-541. doi: 10.1038/s41591-020-0790-y. Epub Mar. 16, 2020.
Zhang et al., Dual base editor catalyzes both cytosine and adenine base conversions in human cells. Nat Biotechnol. Jul. 2020;38(7):856-860. doi: 10.1038/s41587-020-0527-y. Epub Jun. 1, 2020.
Zhang et al., Morphology and ultrastructure of retrovirus particles. AIMS Biophys. 2015;2(3):343-369. doi: 10.3934/biophy.2015.3.343. Epub Aug. 18, 2015. Author Manuscript. 33 pages.
Zheng et al., A flexible split prime editor using truncated reverse transcriptase improves dual-AAV delivery in mouse liver. Mol Ther. Mar. 2, 2022;30(3):1343-1351. doi: 10.1016/j.ymthe.2022.01.005. Epub Jan. 5, 2022.
Zhong et al., Automated Continuous Evolution of Proteins in Vivo. ACS Synth Biol. Jun. 19, 2020;9(6):1270-1276. doi: 10.1021/acssynbio.0c00135. Epub May 12, 2020. Author Manuscript, 14 pages.
Zhong et al., Seven novel variants expand the spectrum of RPE65-related Leber congenital amaurosis in the Chinese population. Mol Vis. Mar. 18, 2019;25:204-214.
Zhuang et al., Increasing the efficiency and precision of prime editing with guide RNA pairs. Nat Chem Biol. Jan. 2022;18(1):29-37. doi: 10.1038/s41589-021-00889-1. Epub Oct. 28, 2021.

* cited by examiner (SEQ ID NO: 47)

```
----:----|----:----|----:----|----:----|----:----|----:----|
MXXXXXXXXXXMXXAJXXAXXXXXXXEXPXGXXJXXBXXXIXXXXNXXXXXXXXXXHAEX   60 Consensus
----.......M..A...A.......E.P.G.........I....N..........HAE.   56 TadA(B.subtilis)
----.......M..A...A.......E.P.G.........I....N..........HAE.   56 TadA(S.aureus)
M..........M..A...A.......E.P.G.........I....N..........HAE.   60 TadA(S.pyogenes)
----:----|----:----|----:----|----:----|----:----|----:----|
XXJXXXXXXXXXXRLXXXTLXVTXEPCXMCXGXXXXXRXXXVXXGAXDXKXGXXXXLXXX  120 Consensus       (SEQ ID NO: 256)
.............RL...TL.VT.EPC.MC.G.....R...V..GA.D.K.G....L...  116 TadA(B.subtilis)(SEQ ID NO: 257)
.............RL...TL.VT.EPC.MC.G.....R...V..GA.D.K.G....L...  116 TadA(S.aureus)  (SEQ ID NO: 258)
.............RL...TL.VT.EPC.MC.G.....R...V..GA.N.K.G....L...  116 TadA(S.pyogenes)(SEQ ID NO: 259)
```

FIG. 14

ADENINE BASE EDITORS WITH REDUCED OFF-TARGET EFFECTS

RELATED APPLICATIONS

This application is a national stage filing under 35 U.S.C. § 371 of International PCT Application PCT/US2020/028568, filed on Apr. 16, 2020, which claims priority under 35 U.S.C. § 119(e) to U.S. Provisional Application, U.S. Ser. No. 62/835,490, filed on Apr. 17, 2019, each of which is incorporated herein by reference.

FEDERALLY SPONSORED RESEARCH

This invention was made with government support under grant numbers AI142756, HG009490, EB022376, and GM118062 awarded by the National Institutes of Health. The government has certain rights in the invention.

BACKGROUND OF THE DISCLOSURE

Base editors enable the precise installation of targeted point mutations in genomic DNA without creating double-stranded DNA breaks (DSBs) (1-3). Adenine base editors (ABEs) convert a target A•T base pair to a G•C base pair (1). Because the mutation of G•C base pairs to A•T base pairs is the primary form of de novo mutation (4), ABEs have the potential to correct almost half of known human pathogenic point mutations (5). The adenine base editor, ABE7.10, can perform remarkably clean and efficient A•T-to-G•C conversion in DNA with very low levels of undesirable byproducts such as small insertions or deletions (indels) in cultured cells, adult mice, plants, and other organisms (1, 6-10).

Off-target base editing can arise from guide RNA-dependent or guide RNA-independent editing events (1, 3). The former results from RNA-guided binding of the Cas9 domain to DNA sites that are similar, but not identical, to the target DNA locus (7, 20-23).

Separately, adenine base editors may induce off-target editing of cellular RNA. Unintended editing of cellular RNA could introduce deleterious effects on the function of translated proteins, and potential associated cytotoxicity. There is an unrecognized need in the art for adenine base editors that have reduced RNA editing activity while retaining high DNA editing efficiency.

SUMMARY OF THE DISCLOSURE

The discovery and widespread implementation of the CRISPR/Cas system has dramatically expanded the toolbox for genome engineering and has revolutionized the future prospects of basic biological research, data storage in living systems, agricultural science, and medicine. The recent development of adenine base editors by fusion of a deaminase to Cas9 enables guide RNA (gRNA)-targeted single nucleotide deamination for A:T base pair conversion to G:C using adenine base editors within a specific target window. Base editing has been broadly demonstrated with high efficiency in a range of species, including human zygotes.

Various engineered base editors with improved DNA editing efficiencies have been developed. Reference is made to Komor, A. C. et al., Improved base excision repair inhibition and bacteriophage Mu Gam protein yields C:G-to-T:A base editors with higher efficiency and product purity, Sci Adv 3 (2017); Rees, H. A. et al., Improving the DNA specificity and applicability of base editing through protein engineering and protein delivery, Nat. Commun. 8, 15790 (2017); U.S. Patent Publication No. 2018/0073012, published Mar. 15, 2018; U.S. Patent Publication No. 2017/0121693, published May 4, 2017; International Publication No. WO 2017/070633, published Apr. 27, 2017; and U.S. Patent Publication No. 2015/0166980, published Jun. 18, 2015, U.S. Pat. No. 9,840,699, issued Dec. 12, 2017; and U.S. Pat. No. 10,077,453, issued Sep. 18, 2018, each of which are incorporated herein in their entireties. Base editors (BEs) may be fusions of a Cas ("CRISPR-associated") domain and a nucleobase (or "base") modification domain (e.g., a natural or evolved deaminase, such as an adenosine deaminase domain). In some cases, base editors may also include proteins or domains that affect cellular DNA repair processes to increase the efficiency and/or stability of the resulting single-nucleotide change.

Base editors reported to date contain a catalytically impaired Cas9 domain fused to a nucleobase modification domain. The Cas9 domain directs the nucleobase modification domain to directly convert one base to another at a guide RNA-programmed target site. Two classes of base editors have been developed to date: Cytosine base editors (CBEs), which convert C•G to T•A, and adenine base editors (ABEs), which convert A•T to G•C. Collectively, CBEs and ABEs enable the correction of all four types of transition mutations (C to T, G to A, A to G, and T to C). As half of known disease-associated gene variants are point mutations, and transition mutations account for ~60% of known pathogenic point mutations, base editors are being widely used to study and treat genetic diseases in a variety of cell types and organisms, including animal models of human genetic diseases.

ABEs are especially useful for the study and correction of pathogenic alleles, as nearly half of pathogenic point mutations in principle can be corrected by converting an A•T base pair to a G•C base pair. Many of the ABEs reported to date include a single polypeptide chain containing a heterodimer of a wild-type *E. coli* TadA monomer (ecTadA, or TadA) that plays a structural role during base editing and a laboratory-evolved *E. coli* TadA monomer TadA7.10 (also referred to herein as "TadA*") that catalyzes deoxyadenosine deamination, and a Cas9 (D10A) nickase. Wild type *E. coli* TadA acts as a homodimer to deaminate an adenosine located in a tRNA anticodon loop, generating inosine (I). Although early ABE variants required a heterodimeric TadA containing an N-terminal wild-type TadA monomer for maximal activity, Joung et al. showed that later ABE variants have comparable activity with and without the wild-type TadA monomer.

The present disclosure is based, at least in part, on the mutagenesis of existing adenine base editors to provide variant ABEs that have reduced off-target effects while retaining high DNA editing efficiency. The adenosine deaminase domain of the ABE7.10 base editor comprises a heterodimer of two adenosine deaminases, one of which is TadA7.10, a deoxyadenosine deaminase that was previously evolved from an *E. coli* tRNA adenosine deaminase to act on single-stranded DNA. (The other deaminase of the heterodimer is a wild-type ecTadA.) TadA7.10 is also comprised within the deaminase domain of ABEmax, which is a variant of ABE7.10 that has been codon-optimized for expression in human cells. TadA7.10 comprises the following substitutions in ecTadA: W23R, H36L, P48A, R51L, L84F, A106V, D108N, H123Y, S146C, D147Y, R152P, E155V, 1156F, and K157N. Reference is made to International Publication No. WO 2018/027078, published Aug. 2, 2018; International Publication No. WO 2019/079347 published Apr. 25, 2019; International Publication No. WO 2019/226593, published Nov. 28, 2019; U.S. Patent Publication No. 2018/0073012, published Mar. 15, 2018, which issued as U.S. Pat. No. 10,113,163, on Oct. 30, 2018; and U.S. Patent Publication No. 2017/0121693, published May 4, 2017, which issued as U.S. Pat. No. 10,167,457 on Jan. 1, 2019.

Many ABEs reported to date comprise single polypeptide chains containing three fused protein components: a wild-type *E. coli* TadA monomer that plays a structural role during base editing, a laboratory-evolved *E. coli* TadA monomer TadA7.10 that catalyzes deoxyadenosine deamination, and a Cas9 (D10A) nickase (1, 3) (see FIGS. 1A, 13A). *E. coli* TadA natively acts as a homodimer to deaminate an adenine located in a tRNA anticodon loop (25), generating inosine (I) (the adenosine is deaminated to a hypoxanthine).

It was hypothesized that the wild-type TadA monomer, which natively acts on RNA but has strict sequence requirements (25, 26), and/or the evolved TadA7.10 monomer, which was evolved to accept ssDNA as a substrate and to have broad sequence compatibility, may be able to catalyze the deamination of cellular RNA (1, 3) (see FIG. 1B). While no substantial ABE7.10-mediated adenosine-to-inosine (A-to-I) editing was previously observed in HEK293T cells among a handful of abundant transcripts sequenced at modest depth (1), the association of elevated endogenous A-to-I editing in the transcriptome with disease (27) warranted a more comprehensive examination of possible ABE-mediated RNA editing. In particular, recent studies have identified aberrant A-to-I editing as a mechanism by which tumors can develop a resistance to immune checkpoint blockade (28).

Guide RNA-dependent off-target base editing has been reduced through strategies including installation of mutations that increase DNA specificity into the Cas9 component of base editors, adding 5' guanosine nucleotides to the sgRNA, or delivery of the base editor as a ribonucleoprotein complex (RNP) (19, 22, 24). Guide RNA-independent off-target editing can arise from binding of the deaminase domain of a base editor to C or A bases in a Cas9-independent manner (3). Recent studies characterized guide RNA-independent off-target DNA editing activity of BE3, the original CBE, in mouse embryos (18) and in rice (17). In contrast with BE3, ABE7.10 in these studies did not result in detectable guide RNA-independent off-target DNA mutations (17, 18). The efficiency of base editors was recently improved through codon- and nuclear localization sequence-optimization to generate ABEmax (15). ABEmax was shown to generate low but detectable levels of widespread adenosine-to-inosine editing in cellular RNAs. The present disclosure is aimed to satisfy a heretofore unrecognized need in the art for the reduction of off-target editing of RNA induced by the deaminase domains of ABEmax and other current adenine base editors.

To address the above-described deficiency in the art, targeted mutagenesis guided by an analysis of deaminase structure was applied to wild-type ecTadA and TadA7.10 deaminases to minimize the ribonucleotide deaminating activity of the domain comprising both deaminases, i.e., the adenosine deaminating activity in RNA. TadA(V106W), an exemplary variant emerging from these mutagenesis experiments, contains a single substitution relative to TadA7.10 at residue 106. TadA(E59A), another exemplary variant emerging from these mutagenesis experiments, contains a single substitution of ecTadA at residue 59. Accordingly, the present disclosure provides TadA(V106W), TadA(E59A), and other TadA7.10 deaminase variants. Adenosine deaminase domains comprising one or more of these variants exhibit reduced off-target effects, such as reduced RNA deamination activity. The present disclosure also provides improved adenine base editors that comprise an adenosine deaminase domain comprising a TadA variant, such as a TadA(E59A), and/or a TadA7.10 variant, such as TadA (V106W). Accordingly, the disclosure provides adenine base editors that are variants of ABE7.10, or ABEmax. The disclosure also provides editing methods, kits and compositions that make use of these ABEmax variants, which minimize the induction of RNA editing in cells.

Accordingly, in some aspects, the present disclosure provides adenine base editors that comprise fusion proteins comprising a nucleic acid DNA binding protein (or napDNAbp) domain and an adenosine deaminase domain. The napDNAbp domain may comprise a Cas9 protein, or a variant thereof, e.g., a Cas9 nickase. The adenosine deaminase domain may comprise one or more adenosine deaminases. In certain embodiments, the adenosine deaminase domain comprises a dimer of a first and second adenosine deaminase. The dimer may be a heterodimer, comprising a first adenosine deaminase that is different from a second adenosine deaminase. The first adenosine deaminase may be positioned N-terminal to the second adenosine deaminase. In various embodiments, the one or more adenosine deaminases are connected by a linker (e.g., a peptide linker).

In various embodiments, the first adenosine deaminase is an *E. coli* TadA (ecTadA) or a variant thereof. In some embodiments, the first adenosine deaminase is an ecTadA having an amino acid substitution at E59 of ecTadA. For instance, this substitution may be an E59A or an E59Q substitution. In some embodiments, the amino acid substitution at residue 59 inactivates the catalytic region of the adenosine deaminase.

In various embodiments, the second adenosine deaminase is an ecTadA or variant thereof. In some embodiments, the second adenosine deaminase is an ecTadA having some or all of the amino acid substitutions comprised within the deaminase TadA7.10 of the adenine base editor ABEmax. The second adenosine deaminase may comprise a variant of TadA7.10 that comprises one or more amino acid substitutions relative to the amino acid sequence of TadA7.10. In certain embodiments, the deaminase comprises a TadA7.10 variant comprising an amino acid substitution at V106 of TadA7.10. For instance, this substitution may comprise a V106W, V106F, V106Q, or a V106M substitution in the amino acid sequence of TadA7.10. In other embodiments, the deaminase comprises an TadA7.10 variant comprising an amino acid substitution at N108 of TadA7.10. For instance, this substitution may comprise an N108W of TadA7.10. In certain embodiments, the deaminase comprises a TadA7.10 variant comprising an amino acid substitution at R47 of TadA7.10. For instance, this substitution may comprise an R46W, R46F, R46Q, or an R46M of TadA7.10. In certain embodiments, the second adenosine deaminase comprises two or more amino acid substitutions selected from V106W, V106F, V106Q, or V106M, N108, and R46W, R46F, R46Q, or R46M of TadA7.10.

The adenosine deaminase domains provided herein (e.g., a heterodimer of adenosine deaminases connected by a linker) comprises a first adenosine deaminase comprising an ecTadA having an amino acid substitution at E59 of ecTadA, and a second adenosine deaminase comprises an TadA7.10 variant comprising an amino acid substitution at V106 of TadA7.10. In certain embodiments, the adenosine deaminase domain comprises a first adenosine deaminase comprising an E59A substitution, and a second deaminase comprising a V106W substitution. In certain embodiments, the adenosine deaminase domain comprises a first adenosine deaminase comprising an E59A substitution, and a second deaminase comprising an N108W substitution. In certain embodiments, the adenosine deaminase domain comprises a first adenosine deaminase comprising an E59A substitution, and a second deaminase comprising a V106W substitution and/or a N108W substitution and/or an R47Q substitution.

In some embodiments, the adenine base editors provided herein may be capable of preserving DNA editing efficiency, and in some embodiments demonstrate improved DNA editing efficiencies, relative to existing adenine base editors, such as ABE7.10. In some embodiments, the ABEs described herein exhibit reduced off-target editing effects while retaining high on-target editing efficiencies. In certain embodiments, the disclosed ABEs exhibit reduced Cas9-independent off-target editing effects while retaining high on-target editing efficiencies. In certain embodiments, the disclosed ABEs exhibit reduced off-target editing effects in cellular mRNA.

In some embodiments, the adenine base editors provided herein are capable of limiting formation of indels in a DNA substrate. In some embodiments, the ABEs provided herein have an expanded target window for editing a DNA substrate than canonical ABEs (e.g., a target window that corresponds to protospacer positions 4-11, 8-14, or 9-14 of the target sequence, wherein protospacer position 0 corresponds to the position of the transcription start site of the target gene). In some embodiments, the adenosine deaminases disclosed herein may be compatible with a variety of Cas homologs, including small-sized, circularly permuted, and evolved Cas homologs.

The present specification further provides methods of DNA editing that make use of the improved adenine base editors. The methods may induce (or yield, provide or cause) an average adenosine (A) to inosine (I) (A-to-I) editing frequency in cellular mRNA transcripts of 0.3% or less, as measured by high throughput screening. In some embodiments, the methods induce (or provide or cause) an average adenosine (A) to inosine (I) (A-to-I) editing frequency across the mRNA transcriptome of a human cell (e.g. an HEK293 cell) of about 0.2% or less.

In some aspects, the present disclosure provides compositions comprising the adenine base editors with reduced off-target effects, such as reduced RNA editing effects, as described herein, e.g., fusion proteins comprising an nCas9 domain and an adenosine deaminase domain (e.g., a heterodimer of a first and second adenosine deaminase), and one or more guide RNAs, e.g., a single-guide RNA ("sgRNA").

In some aspects, the present disclosure provides for nucleic acid molecules encoding and/or expressing the adenine base editors as described herein, and the adenosine deaminase domains thereof, as well as expression vectors or constructs for expressing the adenine base editors described herein and a gRNA, host cells comprising said nucleic acid molecules and expression vectors, and one or more gRNAs, and compositions for delivering and/or administering nucleic acid-based embodiments described herein. The nucleic acid sequences may be codon-optimized for expression in the cells of any organism of interest. In certain embodiments, the nucleic acid sequence is codon-optimized for expression in human cells. In other embodiments, cells containing such nucleic acid molecules and expression vectors are provided.

The present specification further provides complexes comprising the adenine base editors described herein and a gRNA bound to the Cas9 domain of the fusion protein, such as a single guide RNA. The guide RNA may be 15-100 nucleotides in length and comprise a sequence of at least 10, at least 15, or at least 20 contiguous nucleotides that is complementary to a target nucleotide sequence.

In other aspects, the disclosure provides kits for expressing and/or transducing host cells with an expression construct encoding the fusion protein and gRNA. It further provides kits for administration of expressed fusion protein and expressed gRNA molecules to a host cell. The disclosure further provides host cells stably or transiently expressing the fusion protein and gRNA, or a complex thereof.

Methods are also provided for editing a target nucleic acid molecule, e.g., a single nucleobase within a genome, with an adenine base editor described herein, that generate (or cause) reduced off-target effects, e.g. editing of cellular mRNA. Such methods involve transducing (e.g., via transfection) cells with a plurality of complexes each comprising a fusion protein (e.g., a fusion protein comprising a Cas9 nickase (nCas9) domain and an adenosine deaminase domain) and a gRNA molecule. In certain embodiments, the methods involve the transfection of nucleic acid constructs (e.g., plasmids) that each (or together) encode the components of a complex of fusion protein and gRNA molecule. In other embodiments, the methods disclosed herein involve the introduction into cells of a complex comprising a fusion protein and gRNA molecule that has been expressed and cloned outside of these cells.

In some embodiments, the disclosed editing methods result in an actual or average off-target DNA editing frequency of about 2.0% or less. In some embodiments, the editing method results in less than 5% indel formation in the nucleic acid substrate (e.g. a DNA substrate).

In some embodiments, methods of treatment using the disclosed base editors are provided. The methods described herein may comprise treating a subject having or at risk of developing a disease, disorder, or condition, comprising administering to the subject a fusion protein as described herein, a polynucleotide as described herein, a vector as described herein, or a pharmaceutical composition as described herein.

By decoupling DNA and RNA editing activities, the novel adenosine deaminase variants and ABE7.10 variants provided herein increase the precision of adenine base editing by minimizing both RNA and DNA off-target editing activity. These variants may be especially useful for applications that demand minimal RNA editing and high DNA specificity.

The details of one or more embodiments of the disclosure are set forth herein. Other features, objects, and advantages of the disclosure will be apparent from the Detailed Description, Examples, Figures, and Claims. References cited in this application are incorporated herein by reference in their entireties.

BRIEF DESCRIPTION OF THE DRAWINGS

The following drawings form part of the present specification and are included to further demonstrate certain embodiments of the present disclosure, which can be better understood by reference to one or more of these drawings in combination with the detailed description of specific embodiments presented herein.

FIG. 1A illustrates that ABEmax (shown as a schematic model) comprises three proteins fused in a single chain: TadA-TadA*-Cas9(D10A). FIG. 1B illustrates the two TadA monomers (shown as a schematic model) in ABEmax. The schematic models in FIG. 1A and FIG. 1B are generated from independently solved Cas9 (pdb id: 4un3) and *E. coli* TadA (pdb id: 1z3a) structures, as the structure of ABE has not yet been solved. FIG. 1C shows the average A-to-I conversion frequency in three mRNA transcripts from each treatment analyzed by HTS. FIG. 1D shows the number of adenosines within a 220- to 240-nucleotide region of the indicated mRNA that are converted to inosine (read as a G after cDNA synthesis and DNA sequencing) at a detectable level (≥0.1%). Cas9 (D10A) controls show the number of adenosines that are edited by endogenous cellular adenosine deaminases. The amplified regions of RSL1D1, CTNNB1 and IP90 mRNA have 46, 59, and 77 sequenced adenosines, respectively. FIG. 1E shows DNA base editing at seven genomic loci from ABEmax or by ABEmax with mutations at catalytic Glu 59 in TadA or TadA* (TadA7.10). The protospacer position of the target A and the sequence context of the A are shown. FIG. 1F shows RNA editing frequencies at various adenosines within the RSL1D1 amplicon after treatment with the indicated base editors. The adenosine homologous to TadA's native substrate is at position 152 within the amplicon. FIG. 1G shows that on-target DNA base editing with the LDLR sgRNA leads to a U-to-C edit in the LDLR mRNA in the transcriptome-wide RNA-seq data. Alignments were visualized in the Integrated Genomics Viewer (IGV), and aligned to hg38. FIG. 1H illustrates transcriptome-wide RNA-Seq analysis showing the number of high confidence (Phred quality score >20, see Methods) A-to-I variant calls after treatment with the indicated base editors. The dotted line represents the number of A-to-I conversions in the transcriptome from endogenous deaminase activity as measured in the Cas9 (D10A) control samples. FIG. 1I shows the average frequency (%) of A-to-I RNA editing across all transcripts. For FIGS. 1A-1F, data are shown as individual data points and mean±s.d. for n=3 independent biological replicates performed on different days. For FIGS. 1H and II, data are shown as mean±s.e.m. The alignment was generated by combining reads from three independent biological replicates, performed on different days.

FIG. 2D shows DNA base editing at seven genomic loci from ABEmax or ABEmax mutants. FIG. 2E shows the number of adenosines converted to inosine at a detectable level (>0.1%) within a 220- to 240-nt region of the indicated mRNA by ABEmax or ABEmax mutants. The amplified regions of RSL1D1, CTNNB1 and IP90 mRNA have 46, 59, and 77 sequenced adenosines, respectively. The Cas9 (D10A) controls show the number of adenosines that are edited due to endogenous A-to-I editing activity. FIG. 2F shows average A-to-I RNA editing frequencies by ABEmax or ABEmax mutants among 46 adenosines in RSL1D1, 59 in CTNNB1, and 77 in IP90 mRNA transcripts. FIG. 2G shows that on-target DNA base editing with the LDLR sgRNA leads to a U-to-C edit in the LDLR mRNA in the transcriptome-wide RNA-seq data. Alignments were visualized in the Integrated Genomics Viewer (IGV), and aligned to hg38. FIG. 2H illustrates transcriptome-wide RNA-Seq analysis showing the number of high confidence (Phred quality score ≥20, see Methods) A-to-I variant calls after treatment with the indicated base editors. The dotted line represents the number of A-to-I conversions in the transcriptome from endogenous deaminase activity as measured in the Cas9(D10A) control samples. FIG. 2I shows the average frequency (%) of A-to-I RNA editing across all transcripts. For FIGS. 2C-2F, data are shown as individual data points and mean±s.d. for n=3 independent biological replicates performed on different days. For FIGS. 2H and 2I, data are shown as mean±s.e.m. The alignment was generated by combining reads from three independent biological replicates, performed on different days.

FIG. 3A shows classification of the position in which an A-to-I RNA edit was found. "5 kb downstream" refers to mutations that occur within 5 kb downstream of a coding gene and "5 kb upstream" refers to mutations that occur within the region 5 kb upstream of a coding gene. FIG. 3B illustrates that for edits in protein coding regions of mRNAs, edits were classified into synonymous or non-synonymous mutations. FIG. 3C shows that for non-synonymous A-to-I edits in protein-coding regions of RNA, SIFT was used to predict the effect on protein function for these edits. High- or low-confidence calls (indicated in parentheses in the figure) were made according to the standard parameters of the prediction software (see Methods).

FIG. 4A shows catalytically disabled ABE7.10 variants. FIG. 4B shows ABEmax(TadA E59A) variants with mutations at Arg 47 in TadA*. FIG. 4C shows ABEmax(TadA E59A) variants with mutations at Asn 108 in TadA*. FIG. 4D shows ABEmax (TadA E59A) variants with mutations at Val 106 in TadA*. Individual data points and mean±s.d. for n=3 independent biological replicates, performed on different days.

FIG. 14 depicts an alignment of the amino acid sequences of TadA deaminases derived from various species and the consensus *E. coli* TadA amino acid sequence.

DEFINITIONS

Figure 1A:
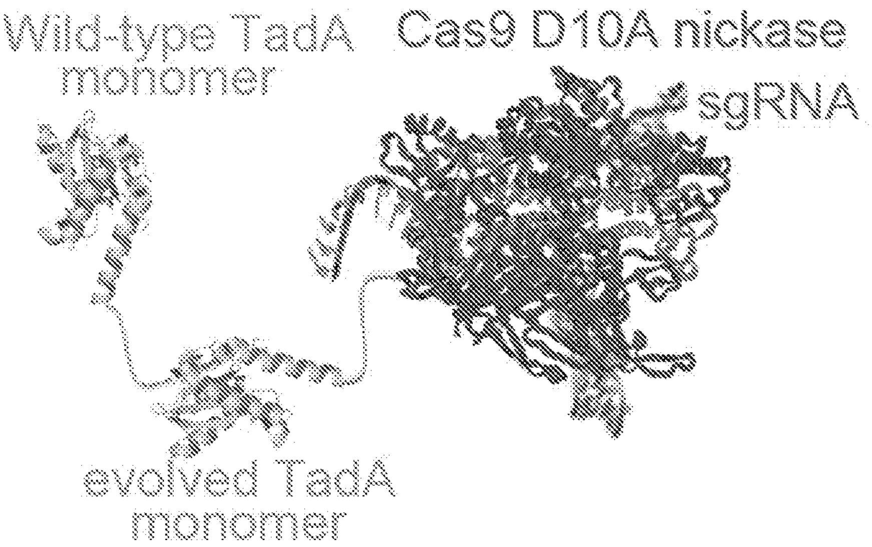
FIGS. 1A to 1I show RNA and DNA editing activity of each TadA monomer in ABEmax.
Figure 1B:
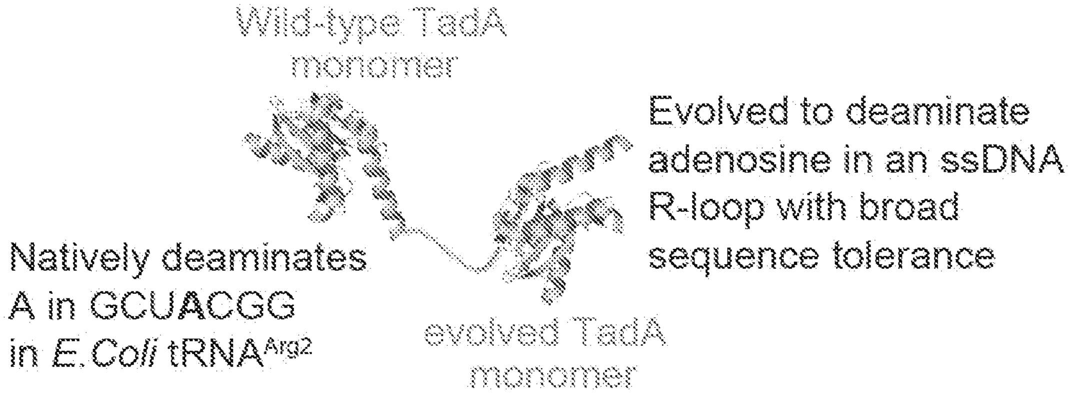

As used herein and in the claims, the singular forms "a," "an," and "the" include the singular and the plural reference unless the context clearly indicates otherwise. Thus, for example, a reference to "an agent" includes a single agent and a plurality of such agents.

As used herein, the term "adenosine deaminase domain" refers to a domain within a fusion protein comprising two or more adenosine deaminases. For instance, an adenosine deaminase domain may comprise a heterodimer of a first adenosine deaminase and a second deaminase domain, connected by a linker.

"Base editing" refers to genome editing technology that involves the conversion of a specific nucleic acid base into another at a targeted genomic locus. In certain embodiments, this can be achieved without requiring double-stranded DNA breaks (DSB), or single stranded breaks (i.e., nicking). To date, other genome editing techniques, including CRISPR-based systems, begin with the introduction of a DSB at a locus of interest. Subsequently, cellular DNA repair enzymes mend the break, commonly resulting in random insertions or deletions (indels) of bases at the site of the DSB. However, when the introduction or correction of a point mutation at a target locus is desired rather than stochastic disruption of the entire gene, these genome editing techniques are unsuitable, as correction rates are low (e.g. typically 0.1% to 5%), with the major genome editing products being indels. In order to increase the efficiency of gene correction without simultaneously introducing random indels, the present inventors previously modified the CRISPR/Cas9 system to directly convert one DNA base into another without DSB formation. See, Komor, A. C., et al., Programmable editing of a target base in genomic DNA without double-stranded DNA cleavage. Nature 533, 420-424 (2016), the entire contents of which is incorporated by reference herein.

The following base editor, which effects transitions (pyrimidine to pyrimidine, or purine to purine) mutations are relevant to the methods disclosed herein.

Adenine base editor (or "ABE"). This type of editor converts an A:T Watson-Crick nucleobase pair to a G:C Watson-Crick nucleobase pair. Because the corresponding Watson-Crick paired bases are also interchanged as a result of the conversion, this category of base editor may also be referred to as a thymine base editor (or "TBE").

The term "base editor (BE)" as used herein, refers to an agent comprising a polypeptide that is capable of making a modification to a base (e.g., A, T, C, G, or U) within a nucleic acid sequence (e.g., DNA or RNA). In some embodiments, the base editor is capable of deaminating a base within a nucleic acid such as a base within a DNA molecule. In the case of an adenine base editor, the base editor is capable of deaminating an adenine (A) in DNA. Such base editors may include a nucleic acid programmable DNA binding protein (napDNAbp) fused to an adenosine deaminase. Some base editors include CRISPR-mediated fusion proteins that are utilized in the base editing methods described herein. In some embodiments, the base editor comprises a nuclease-inactive Cas9 (dCas9) fused to a deaminase which binds a nucleic acid in a guide RNA-programmed manner via the formation of an R-loop, but does not cleave the nucleic acid. For example, the dCas9 domain of the fusion protein may include a D10A and a H840A mutation (which renders Cas9 capable of cleaving only one strand of a nucleic acid duplex), as described in PCT/US2016/058344, which published as WO 2017/070632 on Apr. 27, 2017 and is incorporated herein by reference in its entirety. The DNA cleavage domain of *S. pyogenes* Cas9 includes two subdomains, the HNH nuclease subdomain and the RuvC1 subdomain. The HNH subdomain cleaves the strand complementary to the gRNA (the "targeted strand", or the strand in which editing or deamination occurs), whereas the RuvC1 subdomain cleaves the non-complementary strand containing the PAM sequence (the "non-edited strand"). The RuvC1 mutant D10A generates a nick in the targeted strand, while the HNH mutant H840A generates a nick on the non-edited strand (see Jinek et al., *Science,* 337:816-821(2012); Qi et al., *Cell.* 28; 152(5):1173-83 (2013)).

The term "base editor" encompasses the CRISPR-mediated fusion proteins utilized in the multiplexed base editing methods described herein as well as any base editor known or described in the art at the time of this filing or developed in the future. Reference is made to Rees & Liu, Base editing: precision chemistry on the genome and transcriptome of living cells, Nat. Rev. Genet. 2018; 19(12):770-788; as well as U.S. Patent Publication No. 2018/0073012, published Mar. 15, 2018, which issued as U.S. Pat. No. 10,113,163, on Oct. 30, 2018; U.S. Patent Publication No. 2017/0121693, published May 4, 2017, which issued as U.S. Pat. No. 10,167,457 on Jan. 1, 2019; International Publication No. WO 2017/070633, published Apr. 27, 2017; U.S. Patent Publication No. 2015/0166980, published Jun. 18, 2015; International Publication No. WO 2017/070633, published Apr. 27, 2017; International Publication No. WO 2018/027078, published Aug. 2, 2018; International Application No PCT/US2018/056146, filed Oct. 16, 2018, which published as Publication No. WO 2019/079347 on Apr. 25, 2019; International Application No PCT/US2019/033848, filed May 23, 2019, which published as Publication No. WO 2019/226593 on Nov. 28, 2019; U.S. Patent Publication No. 2015/0166980, published Jun. 18, 2015; U.S. Pat. No. 9,840,699, issued Dec. 12, 2017; U.S. Pat. No. 10,077,453, issued Sep. 18, 2018; International Publication No. WO 2019/023680, published Jan. 31, 2019; International Publication No. WO 2018/0176009, published Sep. 27, 2018; International Application No. PCT/US2019/47996, filed Aug. 23, 2019; International Application No. PCT/US2019/049793, filed Sep. 5, 2019; International Application No. PCT/US2019/61685, filed Nov. 15, 2019; International Application No. PCT/US2019/57956, filed Oct. 24, 2019, the contents of each of which are incorporated herein by reference in their entireties.

The term "Cas9" or "Cas9 nuclease" or "Cas9 domain" refers to a CRISPR-associated protein 9, or variant thereof, and embraces any naturally occurring Cas9 from any organism, any naturally-occurring Cas9 equivalent or fragment thereof, any Cas9 homolog, ortholog, or paralog from any organism, and any variant of a Cas9, naturally-occurring or engineered. The term Cas9 is not meant to be particularly limiting and may be referred to as a "Cas9 or variant thereof." Exemplary Cas9 proteins are described herein and also described in the art. The present disclosure is unlimited with regard to the particular Cas9 that is employed in the CRISPR-mediated fusion proteins utilized in the disclosure.

In some embodiments, proteins comprising Cas9 or fragments thereof are referred to as "Cas9 variants." A Cas9 variant shares homology to Cas9, or a fragment thereof. Cas9 variants include functional fragments of Cas9. For example, a Cas9 variant is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to wild type Cas9. In some embodiments, the Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50 or more amino acid changes compared to a wild type Cas9. In some embodiments, the Cas9 variant comprises a fragment of Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9.

As used herein, the term "dCas9" refers to a nuclease-inactive Cas9 or nuclease-dead Cas9, or a variant thereof, and embraces any naturally occurring dCas9 from any organism, any naturally-occurring dCas9 equivalent or functional fragment thereof, any dCas9 homolog, ortholog, or paralog from any organism, and any variant of a dCas9, naturally-occurring or engineered. The term dCas9 is not meant to be particularly limiting and may be referred to as a "dCas9 or variant thereof." Exemplary dCas9 proteins and method for making dCas9 proteins are further described herein and/or are described in the art and are incorporated herein by reference. Any suitable mutation which inactivates both Cas9 endonucleases, such as D10A and H840A mutations in the wild-type *S. pyogenes* Cas9 amino acid sequence, or D10A and N580A mutations in the wild-type *S. aureus* Cas9 amino acid sequence, may be used to form the dCas9.

As used herein, the term "nCas9" or "Cas9 nickase" refers to a Cas9 or a variant thereof, which cleaves or nicks only one of the strands of a target cut site thereby introducing a nick in a double strand DNA molecule rather than creating a double strand break. This can be achieved by introducing appropriate mutations in a wild-type Cas9 which inactivates one of the two endonuclease activities of the Cas9. Any suitable mutation which inactivates one Cas9 endonuclease activity but leaves the other intact is contemplated, such as one of D10A or H840A mutations in the wild-type *S. pyogenes* Cas9 amino acid sequence, or a D10A mutation in the wild-type *S. aureus* Cas9 amino acid sequence, may be used to form the nCas9.

"CRISPR" is a family of DNA sequences (i.e., CRISPR clusters) in bacteria and archaea that represent snippets of prior infections by a virus that have invaded the prokaryote. The snippets of DNA are used by the prokaryotic cell to detect and destroy DNA from subsequent attacks by similar viruses and effectively constitute, along with an array of CRISPR-associated proteins (including Cas9 and homologs thereof) and CRISPR-associated RNA, a prokaryotic immune defense system. In nature, CRISPR clusters are transcribed and processed into CRISPR RNA (crRNA). In certain types of CRISPR systems (e.g., type II CRISPR systems), correct processing of pre-crRNA requires a trans-encoded small RNA (tracrRNA), endogenous ribonuclease 3 (mc) and a Cas9 protein. The tracrRNA serves as a guide for ribonuclease 3-aided processing of pre-crRNA. Subsequently, Cas9/crRNA/tracrRNA endonucleolytically cleaves linear or circular nucleic acid target complementary to the RNA. Specifically, the target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gRNA") may be engineered so as to incorporate embodiments of both the crRNA and tracrRNA into a single RNA species the guide RNA. See, e.g., Jinek M., et al., Science 337:816-821(2012), the entire contents of which is herein incorporated by reference. Cas9 recognizes a short motif in the CRISPR repeat sequences (the PAM or protospacer adjacent motif) to help distinguish self versus non-self. CRISPR biology, as well as Cas9 nuclease sequences and structures are well known to those of skill in the art (see, e.g., "Complete genome sequence of an M1 strain of *Streptococcus pyogenes*." Ferretti J. J., et al., *Proc. Natl. Acad. Sci. U.S.A.* 98:4658-4663(2001); "CRISPR RNA maturation by trans-encoded small RNA and host factor RNase III." Deltcheva E., et al., *Nature* 471:602-607(2011); and "A programmable dual-RNA-guided DNA endonuclease in adaptive bacterial immunity." Jinek M., et al., *Science* 337:816-821(2012), the entire contents of each of which are incorporated herein by reference). Cas9 orthologs have been described in various species, including, but not limited to, *S. pyogenes, S. thermophiles, C. ulcerans, S. diphtheria, S. syrphidicola, P. intermedia, S. taiwanense, S. iniae, B. baltica, P. torquis, S. thermophilus, L. innocua, C. jejuni* and *N. meningitidis*. Additional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) *RNA Biology* 10:5, 726-737, the entire contents of which are incorporated herein by reference.

The term "deaminase" or "deaminase domain" refers to a protein or enzyme that catalyzes a deamination reaction. In some embodiments, the deaminase is an adenosine deaminase, which catalyzes the hydrolytic deamination of adenine or adenosine. In some embodiments, the adenosine deaminase catalyzes the hydrolytic deamination of adenosine in deoxyribonucleic acid (DNA) to inosine (and thus the conversion of adenine base to hypoxanthine base).

The deaminases provided herein may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

Adenosine deaminases (e.g. engineered adenosine deaminases, evolved adenosine deaminases) provided herein may be may be enzymes that convert adenosine (A) to inosine (I) in DNA or RNA. Such adenosine deaminase can lead to an A:T to G:C base pair conversion. In some embodiments, the deaminase is a variant of a naturally-occurring deaminase from an organism. In some embodiments, the deaminase-does not occur in nature. For example, in some embodiments, the deaminase is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase.

In some embodiments, the adenosine deaminase is derived from a bacterium, such as, *E. coli, S. aureus, S. typhi, S. putrefaciens, H. influenzae*, or *C. crescentus*. In some embodiments, the adenosine deaminase is a TadA deaminase. In some embodiments, the TadA deaminase is an *E. coli* TadA deaminase (ecTadA). In some embodiments, the TadA deaminase is a truncated *E. coli* TadA deaminase. For example, the truncated ecTadA may be missing one or more N-terminal amino acids relative to a full-length ecTadA. In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine. Reference is made to U.S. Patent Publication No. 2018/0073012, published Mar. 15, 2018, which is incorporated herein by reference.

As used herein, the term "DNA binding protein" or "DNA binding protein domain" refers to any protein that localizes to and binds a specific target DNA nucleotide sequence (e.g. a gene locus of a genome). This term embraces RNA-programmable proteins, which associate (e.g. form a complex) with one or more nucleic acid molecules (i.e., which includes, for example, guide RNA in the case of Cas systems) that direct or otherwise program the protein to localize to a specific target nucleotide sequence (e.g., DNA sequence) that is complementary to the one or more nucleic acid molecules (or a portion or region thereof) associated with the protein. Exemplary RNA-programmable proteins are CRISPR-Cas9 proteins, as well as Cas9 equivalents, homologs, orthologs, or paralogs, whether naturally occurring or non-naturally occurring (e.g. engineered or modified), and may include a Cas9 equivalent from any type of CRISPR system (e.g. type II, V, VI), including Cas12a (a type-V CRISPR-Cas system) (formerly known as Cpf1), C2c1 (a type V CRISPR-Cas system), C2c2 (a type VI CRISPR-Cas system), C2c3 (a type V CRISPR-Cas system), a GeoCas9, a CjCas9, a Cas12b, a Cas12g, a Cas12h, a Cas12i, a Cas13b, a Cas13c, a Cas13d, a Cas14, a Csn2, an xCas9, an SpCas9-NG, a Cas9-KKH, a circularly permuted Cas9, an Argonaute (Ago), a SmacCas9, or a Spy-macCas9. Further Cas-equivalents are described in Makarova et al., "C2c2 is a single-component programmable RNA-guided RNA-targeting CRISPR effector," Science 2016; 353(6299), the contents of which are incorporated herein by reference.

The term "DNA editing efficiency," as used herein, refers to the number or proportion of intended base pairs that are edited. For example, if a base editor edits 10% of the base pairs that it is intended to target (e.g., within a cell or within a population of cells), then the base editor can be described as being 10% efficient. Some aspects of editing efficiency embrace the modification (e.g. deamination) of a specific nucleotide within DNA, without generating a large number or percentage of insertions or deletions (i.e., indels). It is generally accepted that editing while generating less than 5% indels (as measured over total target nucleotide substrates) is high editing efficiency. The generation of more than 20% indels is generally accepted as poor or low editing efficiency. Indel formation may be measured by techniques known in the art, including high-throughput screening of sequencing reads.

The term "off-target editing frequency," as used herein, refers to the number or proportion of unintended base pairs, e.g. DNA base pairs, that are edited. On-target and off-target editing frequencies may be measured by the methods and assays described herein, further in view of techniques known in the art, including high-throughput sequencing reads. As used herein, high-throughput sequencing involves the hybridization of nucleic acid primers (e.g., DNA primers) with complementarity to nucleic acid (e.g., DNA) regions just upstream or downstream of the target sequence or off-target sequence of interest. Because the DNA target sequence and the Cas9-independent off-target sequences are known a priori in the methods disclosed herein, nucleic acid primers with sufficient complementarity to regions upstream or downstream of the target sequence and Cas9-independent off-target sequences of interest may be designed using techniques known in the art, such as the PhusionU PCR kit (Life Technologies), Phusion HS II kit (Life Technologies), and Illumina MiSeq kit. Since many of the Cas9-dependent off-target sites have high sequence identity to the target site of interest, nucleic acid primers with sufficient complementarity to regions upstream or downstream of the Cas9-dependent off-target site may likewise be designed using techniques and kits known in the art. These kits make use of polymerase chain reaction (PCR) amplification, which produces amplicons as intermediate products. The target and off-target sequences may comprise genomic loci that further comprise protospacers and PAMs. Accordingly, the term "amplicons," as used herein, may refer to nucleic acid molecules that constitute the aggregates of genomic loci, protospacers and PAMs. High-throughput sequencing techniques used herein may further include Sanger sequencing and/or whole genome sequencing (WGS).

The terms "RNA editing activity," "RNA editing effects" and "RNA off-target editing," as used herein, refer to the introduction of modifications (e.g. deaminations) to nucleotides within cellular RNA, e.g. messenger RNA (mRNA). An important goal of DNA base editing efficiency is the modification (e.g. deamination) of a specific nucleotide within DNA, without introducing modifications of similar nucleotides within RNA. RNA editing effects are "low" or "reduced" when a detected mutation is introduced into RNA molecules at a frequency of 0.3% or less. For reference, the ABEmax base editor introduces edits into RNA at a frequency of about 0.50%. RNA editing effects are "low" or "reduced" when a mutation is detected at a magnitude that is less than about 70,000 edits within an analyzed mRNA transcriptome. The number of RNA edits may be measured by techniques known in the art, including high-throughput screening of sequencing reads and RNA-seq. The effects of RNA editing on the function of a protein translated from the edited mRNA transcript may be predicted by use of the SIFT ("Sorting Intolerant from Tolerant") algorithm, which bases predictions on sequence homology and the physical properties of amino acids.

The term "on-target editing," as used herein, refers to the introduction of intended modifications (e.g., deaminations) to nucleotides (e.g., adenine) in a target sequence, such as using the base editors described herein. The term "off-target DNA editing," as used herein, refers to the introduction of unintended modifications (e.g. deaminations) to nucleotides (e.g. adenine) in a sequence outside the canonical base editor binding window (i.e., from one protospacer position to another, typically 2 to 8 nucleotides long). Off-target DNA editing can result from weak or non-specific binding of the gRNA sequence to the target sequence.

The term "effective amount," as used herein, refers to an amount of a biologically active agent that is sufficient to elicit a desired biological response. For example, in some embodiments, an effective amount of a composition may refer to the amount of the composition that is sufficient to edit a target site of a nucleotide sequence, e.g. a genome. In some embodiments, an effective amount of a composition provided herein, e.g. of a composition comprising a nuclease-inactive Cas9 domain, a deaminase domain, a gRNA and optionally a growth factor and anti-apoptotic factor, may refer to the amount of the composition that is sufficient to induce editing of a target site specifically bound and edited by the fusion protein. In some embodiments, an effective amount of a composition provided herein may refer to the amount of the composition sufficient to induce editing having the following characteristics: >50% product purity, <5% indels, and an editing window of 2-8 nucleotides. As will be appreciated by the skilled artisan, the effective amount of an agent, e.g. a composition or a fusion protein-gRNA complex, may vary depending on various factors as, for example, on the desired biological response, e.g. on the specific allele, genome, or target site to be edited, on the cell or tissue being targeted, and on the agent being used.

The term "evolved base editor" or "evolved base editor variant" refers to a base editor formed as a result of mutagenizing a reference or starting-point base editor. The term refers to embodiments in which the nucleobase modification domain is evolved or a separate domain is evolved. Mutagenizing a reference or starting-point base editor may comprise mutagenizing an adenosine deaminase. Amino acid sequence variations may include one or more mutated residues within the amino acid sequence of a reference base editor, e.g., as a result of a change in the nucleotide sequence encoding the base editor that results in a change in the codon at any particular position in the coding sequence, the deletion of one or more amino acids (e.g., a truncated protein), the insertion of one or more amino acids, or any combination of the foregoing. The evolved base editor may include variants in one or more components or domains of the base editor (e.g., variants introduced into one or more adenosine deaminases).

The term "fusion protein" as used herein refers to a hybrid polypeptide which comprises protein domains from at least two proteins. One protein may be located at the amino-terminal (N-terminal) portion of the fusion protein or at the carboxy-terminal (C-terminal) protein thus forming an "amino-terminal fusion protein" or a "carboxy-terminal fusion protein," respectively. A protein may comprise different domains, for example, a nucleic acid binding domain (e.g., the gRNA binding domain of Cas9 that directs the binding of the protein to a target site) and a nucleic acid cleavage domain or a catalytic domain of a nucleic-acid editing protein. Any of the proteins provided herein may be produced by any method known in the art. For example, the proteins provided herein may be produced via recombinant protein expression and purification, which is especially suited for fusion proteins comprising a peptide linker. Methods for recombinant protein expression and purification are well known, and include those described by Green and Sambrook, *Molecular Cloning: A Laboratory Manual* ($4^{th}$ ed., Cold Spring Harbor Laboratory Press, Cold Spring Harbor, N.Y. (2012)), the entire contents of which are incorporated herein by reference.

The term "host cell," as used herein, refers to a cell that can host, replicate, and transfer a phage vector useful for a continuous evolution process as provided herein. In embodiments where the vector is a viral vector, a suitable host cell is a cell that may be infected by the viral vector, can replicate it, and can package it into viral particles that can infect fresh host cells. A cell can host a viral vector if it supports expression of genes of viral vector, replication of the viral genome, and/or the generation of viral particles. One criterion to determine whether a cell is a suitable host cell for a given viral vector is to determine whether the cell can support the viral life cycle of a wild-type viral genome that the viral vector is derived from. For example, if the viral vector is a modified M13 phage genome, as provided in some embodiments described herein, then a suitable host cell would be any cell that can support the wild-type M13 phage life cycle. Suitable host cells for viral vectors useful in continuous evolution processes are well known to those of skill in the art, and the disclosure is not limited in this respect. In some embodiments, the viral vector is a phage and the host cell is a bacterial cell. In some embodiments, the host cell is an *E. coli* cell. Suitable *E. coli* host strains will be apparent to those of skill in the art, and include, but are not limited to, New England Biolabs (NEB) Turbo, Top10F', DH12S, ER2738, ER2267, and XL1-Blue MRF'. These strain names are art recognized and the genotype of these strains has been well characterized. The term "fresh," as used herein interchangeably with the terms "non-infected" or "uninfected" in the context of host cells, refers to a host cell that has not been infected by a viral vector comprising a gene of interest as used in a continuous evolution process provided herein. A fresh host cell can, however, have been infected by a viral vector unrelated to the vector to be evolved or by a vector of the same or a similar type but not carrying the gene of interest.

In some embodiments, the host cell is a prokaryotic cell, for example, a bacterial cell. In some embodiments, the host cell is an *E. coli* cell. In some embodiments, the host cell is a eukaryotic cell, for example, a yeast cell, an insect cell, or a mammalian cell. The type of host cell, will, of course, depend on the viral vector employed, and suitable host cell/viral vector combinations will be readily apparent to those of skill in the art.

The term "linker," as used herein, refers to a chemical group or a molecule linking two molecules or domains, e.g. dCas9 and a deaminase. Typically, the linker is positioned between, or flanked by, two groups, molecules, or other domains and connected to each one via a covalent bond, thus connecting the two. In some embodiments, the linker is an amino acid or a plurality of amino acids (e.g. a peptide or protein). In some embodiments, the linker is an organic molecule, group, polymer, or chemical domain. Chemical groups include, but are not limited to, disulfide, hydrazone, and azide domains. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 30-35, 35-40, 40-45, 45-50, 50-60, 60-70, 70-80, 80-90, 90-100, 100-150, or 150-200 amino acids in length. Longer or shorter linkers are also contemplated. In some embodiments, the linker is an XTEN linker. In some embodiments, the linker is a 32-amino acid linker. In other embodiments, the linker is a 30-, 31-, 33- or 34-amino acid linker.

As used herein, the term "low toxicity" refers to the maintenance of a viability above 60% in a population of cells following application of a base editing method or administration of a composition disclosed herein. The term may also refer to prevention of apoptosis (cell death) in a population of cells of more than 40%. For instance, a genome editing method that leads to less than 30% (e.g. 25%, 20%, 15%, 10%, or 5%) cell death exhibits low toxicity. Cell toxicity may be assessed by an appropriate staining assay, e.g. Annexin V and propidium iodide staining assays, and subsequent flow cytometry (e.g. FACS).

The term "mutation," as used herein, refers to a substitution of a residue within a sequence, e.g., a nucleic acid or amino acid sequence, with another residue; a deletion or insertion of one or more residues within a sequence; or a substitution of a residue within a sequence of a genome in a subject to be corrected. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, *Molecular Cloning: A Laboratory Manual* ($4^{th}$ ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is a result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. There are some exceptions where a loss-of-function mutation is dominant, one example being haploinsufficiency, where the organism is unable to tolerate the approximately 50% reduction in protein activity suffered by the heterozygote. This is the explanation for a few genetic diseases in humans, including Marfan syndrome, which results from a mutation in the gene for the connective tissue protein called fibrillin. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Alternatively the mutation could lead to overexpression of one or more genes involved in control of the cell cycle, thus leading to uncontrolled cell division and hence to cancer. Because of their nature, gain-of-function mutations are usually dominant.

The terms "non-naturally occurring" or "engineered" are used interchangeably and indicate the involvement of the hand of man. These terms, when referring to nucleic acid molecules or polypeptides (e.g. deaminases) mean that the nucleic acid molecule or the polypeptide is at least substantially free from at least one other component with which they are naturally associated in nature and/or as found in nature (e.g. an amino acid sequence not found in nature).

The term "nucleic acid," as used herein, refers to RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g. a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, e.g. analogs having other than a phosphodiester backbone. Nucleic acids may be purified from natural sources, produced using recombinant expression systems and optionally purified, chemically synthesized, etc. Where appropriate, e.g. in the case of chemically synthesized molecules, nucleic acids may comprise nucleoside analogs such as analogs having chemically modified bases or sugars, and backbone modifications. A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g. 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, inosinedenosine, 8-oxoguanosine, 0(6)-methylguanine, and 2-thiocytidine); chemically modified bases; biologically modified bases (e.g. methylated bases); intercalated bases; modified sugars (e.g. 2'-fluororibose, ribose, 2'-deoxyribose, arabinose, and hexose); and/or modified phosphate groups (e.g. phosphorothioates and 5'-N-phosphoramidite linkages).

As used herein to modify guide RNA molecules, the term "backbone" refers to the component of the guide RNA that comprises the core region, also known as the crRNA/tracrRNA. The backbone is separate from the guide sequence, or spacer, region of the guide RNA, which has complementarity to a protospacer of a nucleic acid molecule.

The term "nucleic acid programmable DNA binding protein (napDNAbp)" refers to any protein that may associate (e.g., form a complex) with one or more nucleic acid molecules (i.e., which may broadly be referred to as a "napDNAbp-programming nucleic acid molecule" and includes, for example, guide RNA in the case of Cas systems) which direct or otherwise program the protein to localize to a specific target nucleotide sequence (e.g., a gene locus of a genome) that is complementary to the one or more nucleic acid molecules (or a portion or region thereof) associated with the protein, thereby causing the protein to bind to the nucleotide sequence at the specific target site. This term napDNAbp embraces CRISPR-Cas9 proteins, as well as Cas9 equivalents, homologs, orthologs, or paralogs, whether naturally occurring or non-naturally occurring (e.g., engineered or modified), and may include a Cas9 equivalent from any type of CRISPR system (e.g., type II, V, VI), including Cas12a (a type-V CRISPR-Cas system) (formerly known as Cpf1), C2c1 (a type V CRISPR-Cas system), C2c2 (a type VI CRISPR-Cas system), C2c3 (a type V CRISPR-Cas system), a GeoCas9, a CjCas9, a Cas12b, a Cas12g, a Cas12h, a Cas12i, a Cas13b, a Cas13c, a Cas13d, a Cas14, a Csn2, an xCas9, an SpCas9-NG, a Cas9-KKH, a circularly permuted Cas9, an Argonaute (Ago), a SmacCas9, or a Spy-macCas9. The napDNAbp may be a Cas9 domain that comprises a nuclease active Cas9 domain, a nuclease inactive Cas9 (dCas9) domain, or a Cas9 nickase (nCas9) domain. Further Cas equivalents are described in Makarova et al., "C2c2 is a single-component programmable RNA-guided RNA-targeting CRISPR effector," *Science* 2016; 353 (6299), the contents of which are incorporated herein by reference. However, the nucleic acid programmable DNA binding protein (napDNAbp) that may be used in connection with this disclosure are not limited to CRISPR-Cas systems. The claimed invention embraces any such programmable protein, such as the Argonaute protein from *Natronobacterium gregoryi* (NgAgo) which may also be used for DNA-guided genome editing. NgAgo-guide DNA system does not require a PAM sequence or guide RNA molecules, which means genome editing can be performed simply by the expression of generic NgAgo protein and introduction of synthetic oligonucleotides on any genomic sequence. See Gao et al., DNA-guided genome editing using the *Natronobacterium gregoryi* Argonaute. *Nature Biotechnology* 2016; 34(7):768-73, which is incorporated herein by reference.

Figure 1C:
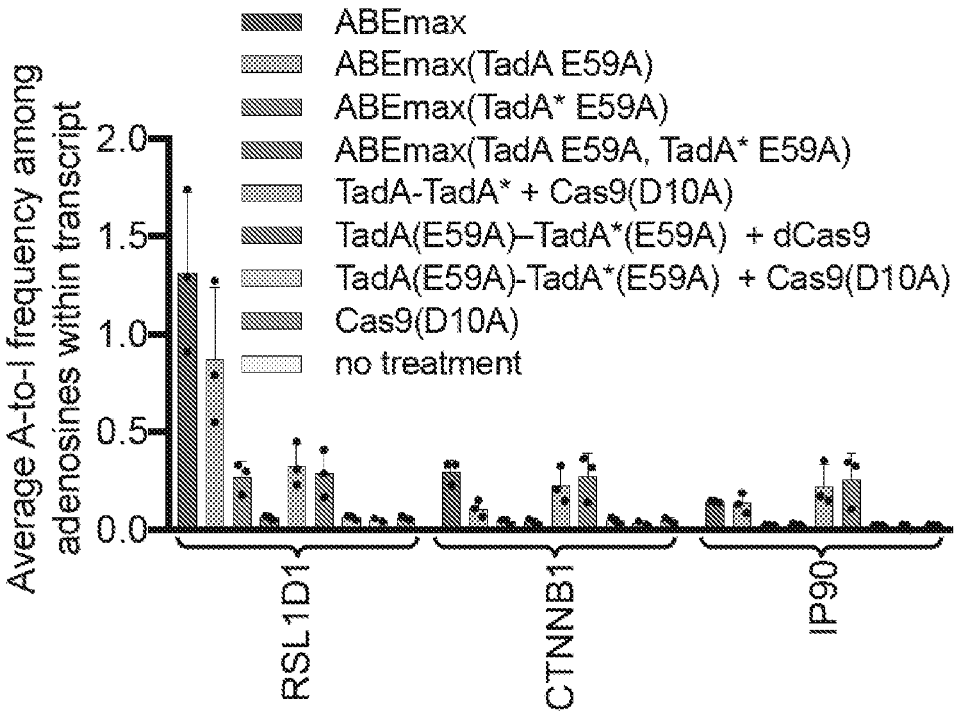
Figure 1D:
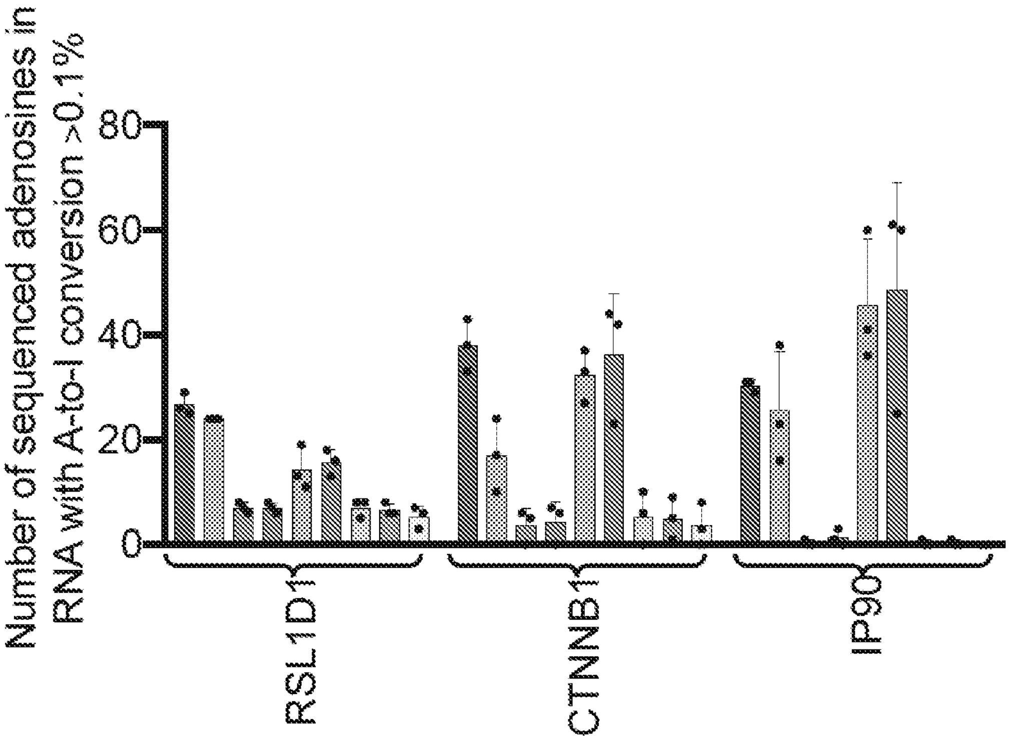
Figure 1E:
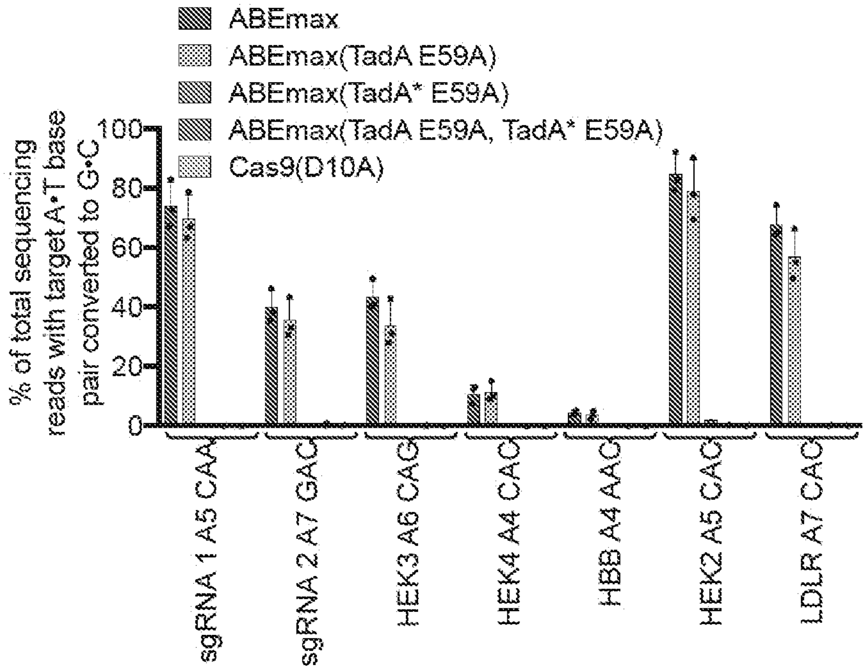

In some embodiments, the napDNAbp is a RNA-programmable nuclease, when in a complex with an RNA, may be referred to as a nuclease:RNA complex. Typically, the bound RNA(s) is referred to as a guide RNA (gRNA). gRNAs can exist as a complex of two or more RNAs, or as a single RNA molecule. gRNAs that exist as a single RNA molecule may be referred to as single-guide RNAs (sgRNAs), though "gRNA" is used interchangeabley to refer to guide RNAs that exist as either single molecules or as a complex of two or more molecules. Typically, gRNAs that exist as single RNA species comprise two domains: (1) a domain that shares homology to a target nucleic acid (e.g., and directs binding of a Cas9 (or equivalent) complex to the target); and (2) a domain that binds a Cas9 protein. In some embodiments, domain (2) corresponds to a sequence known as a tracrRNA, and comprises a stem-loop structure. For example, in some embodiments, domain (2) is homologous to a tracrRNA as depicted in FIG. 1E of Jinek et al., *Science* 337:816-821(2012), the entire contents of which is incorporated herein by reference. Other examples of gRNAs (e.g., those including domain 2) can be found in U.S. Pat. No. 9,340,799, entitled "mRNA-Sensing Switchable gRNAs," and International Patent Application No. PCT/US2014/054247, filed Sep. 6, 2013, published as WO 2015/035136 and entitled "Delivery System For Functional Nucleases," the entire contents of each are herein incorporated by reference. In some embodiments, a gRNA comprises two or more of domains (1) and (2), and may be referred to as an "extended gRNA." For example, an extended gRNA will, e.g., bind two or more Cas9 proteins and bind a target nucleic acid at two or more distinct regions, as described herein. The gRNA comprises a nucleotide sequence that complements a target site, which mediates binding of the nuclease/RNA complex to said target site, providing the sequence specificity of the nuclease:RNA complex. In some embodiments, the RNA-programmable nuclease is the (CRISPR-associated system) Cas9 endonuclease, for example Cas9 (Csnl) from *Streptococcus pyogenes* (see, e.g., "Complete genome sequence of an M1 strain of *Streptococcus pyogenes*." Ferretti J. J. et al., *Proc. Natl. Acad. Sci. U.S.A.* 98:4658-4663(2001); "CRISPR RNA maturation by trans-encoded small RNA and host factor RNase III." Deltcheva E. et al., Nature 471:602-607(2011); and "A programmable dual-RNA-guided DNA endonuclease in adaptive bacterial immunity." Jinek M. et al., Science 337:816-821(2012), the entire contents of each of which are incorporated herein by reference.

The napDNAbp nucleases (e.g., Cas9) use RNA:DNA hybridization to target DNA cleavage sites, these proteins are able to be targeted, in principle, to any sequence specified by the guide RNA. Methods of using napDNAbp nucleases, such as Cas9, for site-specific cleavage (e.g., to modify a genome) are known in the art (see e.g., Cong, L. et al. Multiplex genome engineering using CRISPR/Cas systems. Science 339, 819-823 (2013); *Mali*, P. et al. RNA-guided human genome engineering via Cas9. Science 339, 823-826 (2013); Hwang, W. Y. et al. Efficient genome editing in zebrafish using a CRISPR-Cas system. *Nature Biotechnology* 31, 227-229 (2013); Jinek, M. et al. RNA-programmed genome editing in human cells. eLife 2, e00471 (2013); Dicarlo, J. E. et al., Genome engineering in *Saccharomyces cerevisiae* using CRISPR-Cas systems. *Nucleic Acid Res.* (2013); Jiang, W. et al. RNA-guided editing of bacterial genomes using CRISPR-Cas systems.

*Nature Biotechnology* 31, 233-239 (2013); the entire contents of each of which are incorporated herein by reference).

The term "napDNAbp-programming nucleic acid molecule" or equivalently "guide sequence" refers the one or more nucleic acid molecules which associate with and direct or otherwise program a napDNAbp protein to localize to a specific target nucleotide sequence (e.g., a gene locus of a genome) that is complementary to the one or more nucleic acid molecules (or a portion or region thereof) associated with the protein, thereby causing the napDNAbp protein to bind to the nucleotide sequence at the specific target site. A non-limiting example is a guide RNA of a Cas protein of a CRISPR-Cas genome editing system.

A nuclear localization signal or sequence (NLS) is an amino acid sequence that tags, designates, or otherwise marks a protein for import into the cell nucleus by nuclear transport. Typically, this signal consists of one or more short sequences of positively charged lysines or arginines exposed on the protein surface. Different nuclear localized proteins may share the same NLS. An NLS has the opposite function of a nuclear export signal (NES), which targets proteins out of the nucleus. Thus, a single nuclear localization signal can direct the entity with which it is associated to the nucleus of a cell. Such sequences may be of any size and composition, for example more than 25, 25, 15, 12, 10, 8, 7, 6, 5, or 4 amino acids, but will preferably comprise at least a four to eight amino acid sequence known to function as a nuclear localization signal (NLS). In some embodiments, the disclosed NLSs are bipartite NLSs ("bpNLS").

The term "promoter" is art-recognized and refers to a nucleic acid molecule with a sequence recognized by the cellular transcription machinery and able to initiate transcription of a downstream gene. A promoter may be constitutively active, meaning that the promoter is always active in a given cellular context, or conditionally active, meaning that the promoter is only active in the presence of a specific condition. For example, a conditional promoter may only be active in the presence of a specific protein that connects a protein associated with a regulatory element in the promoter to the basic transcriptional machinery, or only in the absence of an inhibitory molecule. A subclass of conditionally active promoters are inducible promoters that require the presence of a small molecule "inducer" for activity. Examples of inducible promoters include, but are not limited to, arabinose-inducible promoters, Tet-on promoters, and tamoxifen-inducible promoters. A variety of constitutive, conditional, and inducible promoters are well known to the skilled artisan, and the skilled artisan will be able to ascertain a variety of such promoters useful in carrying out the present disclosure, which is not limited in this respect. In various embodiments, the disclosure provides vectors with appropriate promoters for driving expression of the nucleic acid sequences encoding the fusion proteins (or one or more individual components thereof).

The term "recombinant" as used herein in the context of proteins or nucleic acids refers to proteins or nucleic acids that do not occur in nature, but are the product of human engineering. For example, in some embodiments, a recombinant protein or nucleic acid molecule comprises an amino acid or nucleotide sequence that comprises at least one, at least two, at least three, at least four, at least five, at least six, or at least seven mutations as compared to any naturally occurring sequence.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode. In some embodiments, the subject is a research animal. In some embodiments, the subject is genetically engineered, e.g. a genetically engineered non-human subject. The subject may be of either sex and at any stage of development.

The term "target site" refers to a sequence within a nucleic acid molecule that is edited by a fusion protein (e.g. a dCas9-deaminase fusion protein provided herein). The target site further refers to the sequence within a nucleic acid molecule to which a complex of the fusion protein and gRNA binds.

The terms "treatment," "treat," and "treating," refer to a clinical intervention aimed to reverse, alleviate, delay the onset of, or inhibit the progress of a disease, disorder, or condition, or one or more symptoms thereof, as described herein. As used herein, the terms "treatment," "treat," and "treating" refer to a clinical intervention aimed to reverse, alleviate, delay the onset of, or inhibit the progress of a disease, disorder, or condition, or one or more symptoms thereof, as described herein. In some embodiments, treatment may be administered after one or more symptoms have developed and/or after a disease has been diagnosed. In other embodiments, treatment may be administered in the absence of symptoms, e.g. to prevent or delay onset of a symptom or inhibit onset or progression of a disease. For example, treatment may be administered to a susceptible individual prior to the onset of symptoms (e.g. in light of a history of symptoms and/or in light of genetic or other susceptibility factors). Treatment may also be continued after symptoms have resolved, for example, to prevent or delay their prevention or recurrence.

As used herein, e.g. for the purposes of reporting a specific number of loci, the terms "unique loci" and "unique genomic loci" refer to distinct genomic sequences (e.g. distinct coding sequences) wherein all copies of a distinct sequence in the genome are collectively counted (or reported) only once; in contrast, each copy of a "non-unique locus" or "repetitive element" is counted for purposes of reporting a specific number of loci.

As used herein, the term "variant" refers to a protein having characteristics that deviate from what occurs in nature that retains at least one functional i.e. binding, interaction, or enzymatic ability and/or therapeutic property thereof. A "variant" is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the wild type protein. For instance, a variant of Cas9 may comprise a Cas9 that has one or more changes in amino acid residues as compared to a wild type Cas9 amino acid sequence. As another example, a variant of a deaminase may comprise a deaminase that has one or more changes in amino acid residues as compared to a wild type deaminase amino acid sequence, e.g. following ancestral sequence reconstruction of the deaminase. These changes include chemical modifications, including substitutions of different amino acid residues truncations, covalent additions (e.g. of a tag), and any other mutations. This term also embraces fragments of a wild type protein.

The level or degree of which the property is retained may be reduced relative to the wild type protein but is typically the same or similar in kind. Generally, variants are overall very similar, and in many regions, identical to the amino acid sequence of the protein described herein. A skilled artisan will appreciate how to make and use variants that maintain all, or at least some, of a functional ability or property.

The variant proteins may comprise, or alternatively consist of, an amino acid sequence which is at least 80%, 85%, 90%, 95%, 96%, 97%, 98%, 99%, or 100%, identical to, for example, the amino acid sequence of a wild-type protein, or any protein provided herein (e.g. Cas9 protein, fusion protein, and fusion protein protein). Further polypeptides provided in the disclosure are encoded by polynucleotides which hybridize to the complement of a nucleic acid molecule encoding a protein such as a Cas9 protein under stringent hybridization conditions (e.g. hybridization to filter bound DNA in 6× Sodium chloride/Sodium citrate (SSC) at about 45 degrees Celsius, followed by one or more washes in 0.2.times.SSC, 0.1% SDS at about 50-65 degrees Celsius), under highly stringent conditions (e.g. hybridization to filter bound DNA in 6× sodium chloride/Sodium citrate (SSC) at about 45 degrees Celsius, followed by one or more washes in 0.1×SSC, 0.2% SDS at about 68 degrees Celsius), or under other stringent hybridization conditions which are known to those of skill in the art (see, for example, Ausubel, F. M. et al., eds., 1989 *Current Protocol in Molecular Biology*, Green publishing associates, Inc., and John Wiley & Sons Inc., New York, at pp. 6.3.1-6.3.6 and 2.10.3).

By a polypeptide having an amino acid sequence at least, for example, 95% "identical" to a query amino acid sequence, it is intended that the amino acid sequence of the subject polypeptide is identical to the query sequence except that the subject polypeptide sequence may include up to five amino acid alterations per each 100 amino acids of the query amino acid sequence. In other words, to obtain a polypeptide having an amino acid sequence at least 95% identical to a query amino acid sequence, up to 5% of the amino acid residues in the subject sequence may be inserted, deleted, or substituted with another amino acid. These alterations of the reference sequence may occur at the amino- or carboxy-terminal positions of the reference amino acid sequence or anywhere between those terminal positions, interspersed either individually among residues in the reference sequence or in one or more contiguous groups within the reference sequence.

As a practical matter, whether any particular polypeptide is at least 80%, 85%, 90%, 95%, 96%, 97%, 98%, or 99% identical to, for instance, the amino acid sequence of a protein such as a Cas9 protein, can be determined conventionally using known computer programs. A preferred method for determining the best overall match between a query sequence (a sequence of the present disclosure) and a subject sequence, also referred to as a global sequence alignment, can be determined using the FASTDB computer program based on the algorithm of Brutlag et al. (*Comp. App. Biosci.* 6:237-245 (1990)). In a sequence alignment the query and subject sequences are either both nucleotide sequences or both amino acid sequences. The result of said global sequence alignment is expressed as percent identity. Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter.

If the subject sequence is shorter than the query sequence due to N- or C-terminal deletions, not because of internal deletions, a manual correction must be made to the results. This is because the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. Whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of the present disclosure. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence.

As used herein, the term "wild type" is a term of the art understood by skilled persons and means the typical form of an organism, strain, gene or characteristic as it occurs in nature as distinguished from mutant or variant forms.

These and other exemplary substituents are described in more detail in the Detailed Description, Examples, and claims. The invention is not intended to be limited in any manner by the above exemplary listing of substituents.

DETAILED DESCRIPTION OF CERTAIN EMBODIMENTS

The present disclosure provides adenine base editors that are variants of ABEmax that feature a significantly lower RNA editing footprint while retaining DNA editing fidelity. The disclosed adenine base editors that comprise an adenosine deaminase domain (e.g., a variant of an adenosine deaminase that deaminates deoxyadenosine in DNA as described herein) and a napDNAbp domain (e.g., a Cas9 protein) capable of binding to a specific nucleotide sequence. The deamination of an adenosine by an adenosine deaminase may lead to a point mutation from adenine (A) to guanine (G), a process referred to herein as base editing. For example, the adenosine may be converted to an inosine residue. Within the constraints of a DNA polymerase active site, inosine pairs most stably with C and therefore is read or replicated by the cell's replication machinery as a guanine (G). Such base editors are useful inter alia for targeted editing of nucleic acid sequences. Such base editors may be used for targeted editing of DNA in vitro, e.g., for the generation of mutant cells or animals. Such base editors may be used for for the introduction of targeted mutations, e.g., for the correction of genetic defects in cells ex vivo, e.g., in cells obtained from a subject that are subsequently re-introduced into the same or another subject, or for multiplexed editing of a genome. And these base editors may be used for the introduction of targeted mutations in vivo, e.g., the correction of genetic defects or the introduction of deactivating mutations in disease-associated genes in a subject, or for multiplexed editing of a genome. The adenine base editors described herein may be utilized for the targeted editing of G to A mutations (e.g., targeted genome editing). The disclosure provides deaminases, base editors, nucleic acids, vectors, cells, compositions, methods, kits, and uses that utilize the deaminases and base editors provided herein. In particular aspects, base editing methods comprising contacting a nucleic acid molecule with an adenine base editor and a guide RNA that has complementarity to a target sequence are disclosed; as well as kits and pharmaceutical compositions for the administration of ABE7.10 variants to a host cell.

ABE7.10 (ABEmax) was shown to generate detectable levels of widespread adenosine-to-inosine editing in cellular RNAs. Using structure-guided principles to design mutations in both deaminase domains, new ABE variants were developed that retain their ability to edit DNA efficiently but show greatly reduced off-target effects, such as reduced RNA editing activity, off-target DNA editing activity, and indel byproduct formation, in three mammalian cell lines.

Figure 2A:
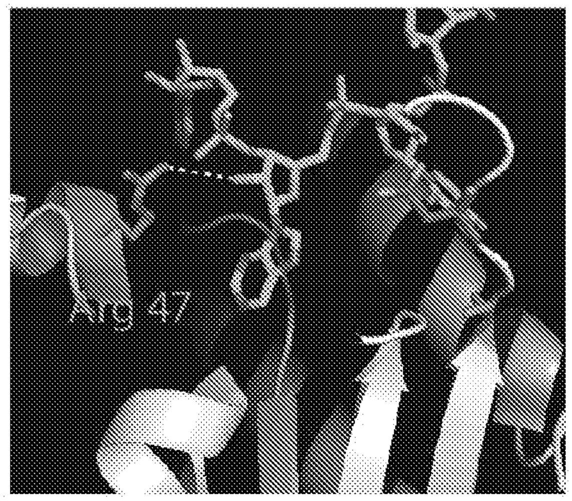
FIGS. 2A to 2I show the design and testing of ABE7.10 variants (or ABEmax variants) with reduced RNA editing activity. Views of the structure of *S. aureus* TadA bound to a minimized version of its native substrate ($tRNA^{Arg2}$) (PDB: 2B3J) (25), showing the residues homologous to Arg 47 (FIG. 2A), Asp 108 (FIG. 2B), and Ala 106 (FIG. 2C) in *E. coli* TadA. Asp 108 is mutated to Asn 108 in the evolved TadA*, while Ala 106 is mutated to Val 106 in TadA* (1).
Figure 2B:
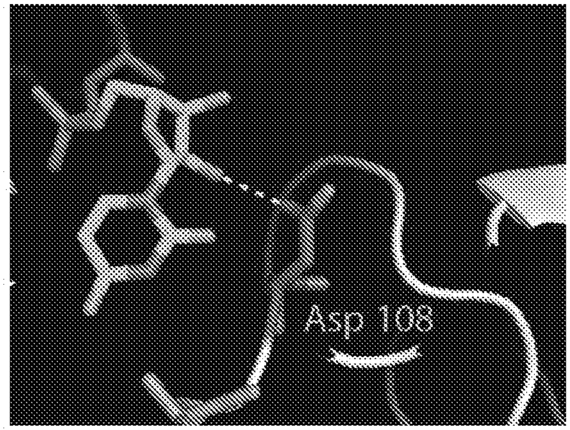
Figure 2C:
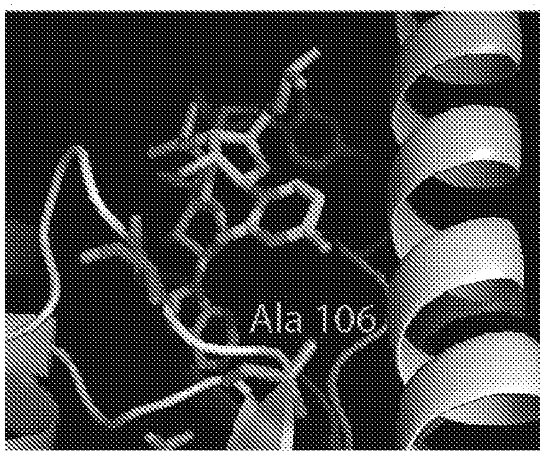

Given the lack of an elucidated structure of ABE or of the *E. coli* TadA homodimer bound to RNA, the crystal structure of was used for targeted mutagenesis of wild-type *E. coli* TadA deaminases to design that reduce undesired RNA editing activity. *S. aureus* TadA has high sequence homology to *E. coli* TadA (25). Three TadA* residues were identified, predicted to interact with the RNA substrate as targets for substitutions that might impair TadA*-mediated RNA deamination. It was hypothesized that impeding the ability of TadA* to accommodate 2'-hydroxyl groups that are present in RNA, but absent in DNA, by replacing these three amino acids with larger or more hydrophobic residues (Gln, Phe, Trp, or Met) could further improve the DNA versus RNA editing specificity of ABEmax comprising an adenosine deaminase domain comprising a mutated TadA(E59A) (or ABEmax(TadA(E59W)). Arginine 47 is predicted to form a hydrogen bond with the 2'-hydroxyl group of the substrate adenosine (FIG. 2A). Arg 47 was replaced in TadA* with Gln, Phe, Trp, or Met in an effort to abrogate this interaction. A series of ABEmax mutants was generated with TadA* substitutions at either Aspartine 108 (FIG. 2B) or Valine 106 (FIG. 2C), two residues that are located close to the catalytic site of TadA, and that mutated from Asp 108 and Ala 106 during the evolution of TadA*(1). Aspartine 108 is predicted to directly hydrogen bond with the 2'-hydroxyl group of the uridine immediately 5' of the substrate adenosine (FIG. 2B), and replacement of Alanine 106 might fill some of the space that accommodates this uridine, including its 2' hydroxyl group, with larger and more hydrophobic side chains (FIG. 2C). Asn 108 was replaced in ABEmax TadA* with Gln, Phe, Trp, Lys, or Met, and Val 106 in ABEmax TadA* with Gln, Phe, Trp, or Met, in an effort to disrupt the ability of TadA* to accommodate ribonucleotides by eliminating the possibility of forming hydrogen bonds with 2' hydroxyl groups in RNA or by steric occlusion. An additional mutation of Aspartine 108 to lysine was also designed.

Using structure-guided mutagenesis approaches, ABE7.10 variants were designed with mutations in both TadA domains demonstrated greatly reduced RNA editing while maintaining efficient target DNA editing, improving DNA specificity, and reducing indel byproduct formation. An ABE7.10 variant comprising an adenosine deaminase domain comprising TadA(E59W) and TadA7.10(V106W) generated particularly low levels of off-target effects. TadA7.10(V106W) comprises the following substitutions in ecTadA: W23R, H36L, P48A, R51L, L84F, A106W, D108N, H123Y, S146C, D147Y, R152P, E155V, I156F, and K157N. Another ABE7.10 variant comprising an adenosine deaminase domain comprising TadA(E59W) and TadA7.10 (N108W) generated particularly low levels of off-target effects. TadA7.10(N108W) comprises the following substitutions in ecTadA: W23R, H36L, P48A, R51L, L84F, A106V, D108W, H123Y, S146C, D147Y, R152P, E155V, I156F, and K157N.

Off-target activity may arise because of imperfect hybridization of the napDNAbp-guide RNA complex to sequences that share identity with the target sequence. Otherwise, off-target activity may occur independently of the napDNAbp-guide RNA complex arise as a result of stochastic binding of the adenine base editor to DNA sequences (often sequences that do not share high sequence identity with the target sequence) due to an intrinsic affinity of the base editor of the nucleotide modification domain (e.g., the deaminase domain) of the base editor with DNA. NapDNAbp-independent (e.g., Cas9-independent) editing events arise in particular when the base editor is overexpressed in the system under evaluation, such as a cell or a subject.

In the experiments described herein, A-to-I editing attributable to the overexpression of ABEmax, the most efficient ABE variant reported to date (15), was measured with high sensitivity. Targeted deep sequencing of individual abundant mRNA transcripts and transcriptome-wide RNA-seq techniques were utilized to demonstrate that ABEmax induced low levels of widespread adenosine-to-inosine (A-to-I) editing across the transcriptome. Comparison of RNA editing rates between ABEmax mutants with catalytically disabled deaminase domains revealed that both the wild-type *E. coli* TadA monomer that plays a structural role during base editing and laboratory-evolved *E. coli* TadA7.10 (TadA*) that catalyzes deoxyadenosine deamination contribute to RNA editing. This may represent the first recognition of off-target RNA editing in ABEmax and thus the first recognition of this deficiency in the art.

Figure 2D:
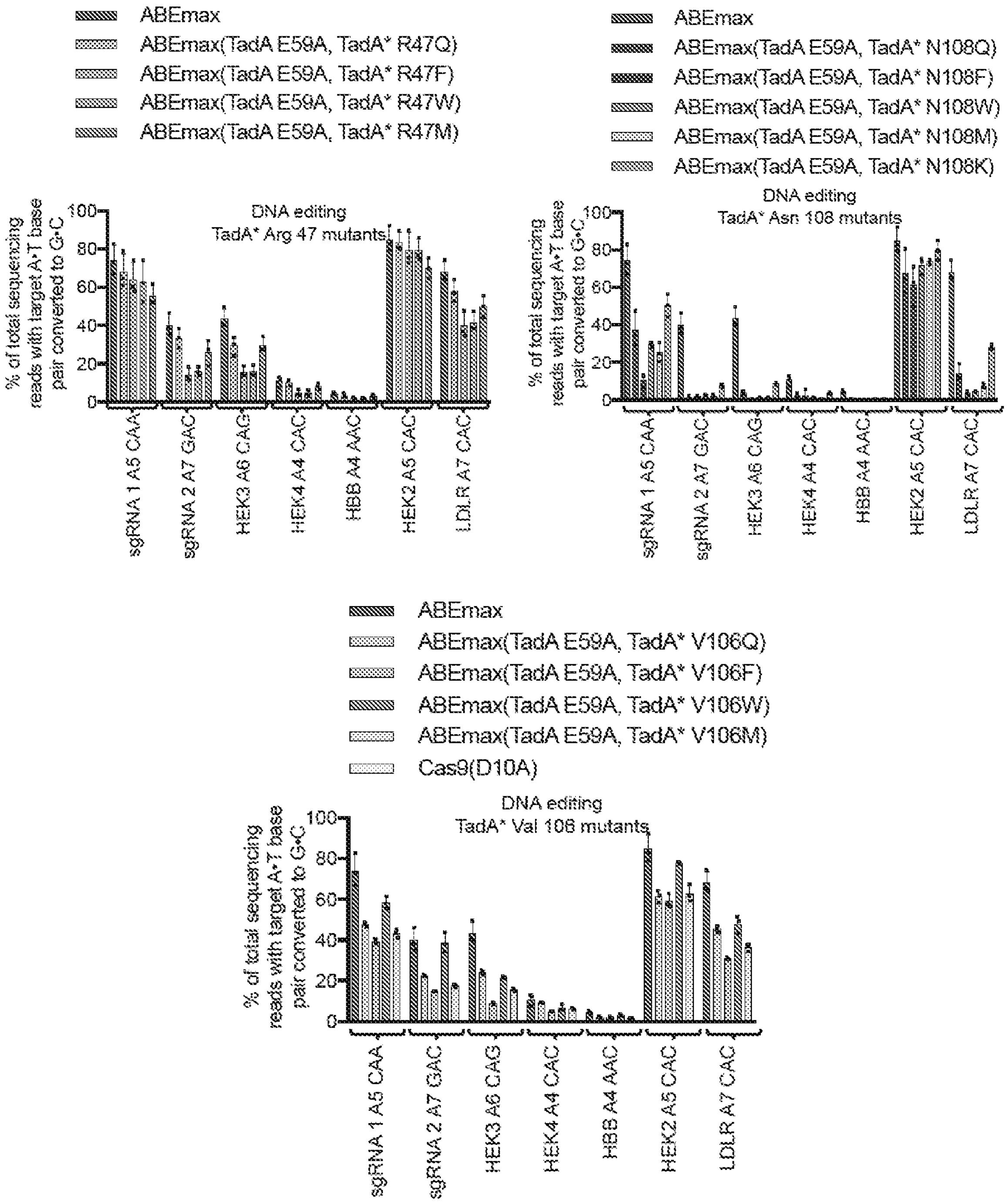
Figure 2E:
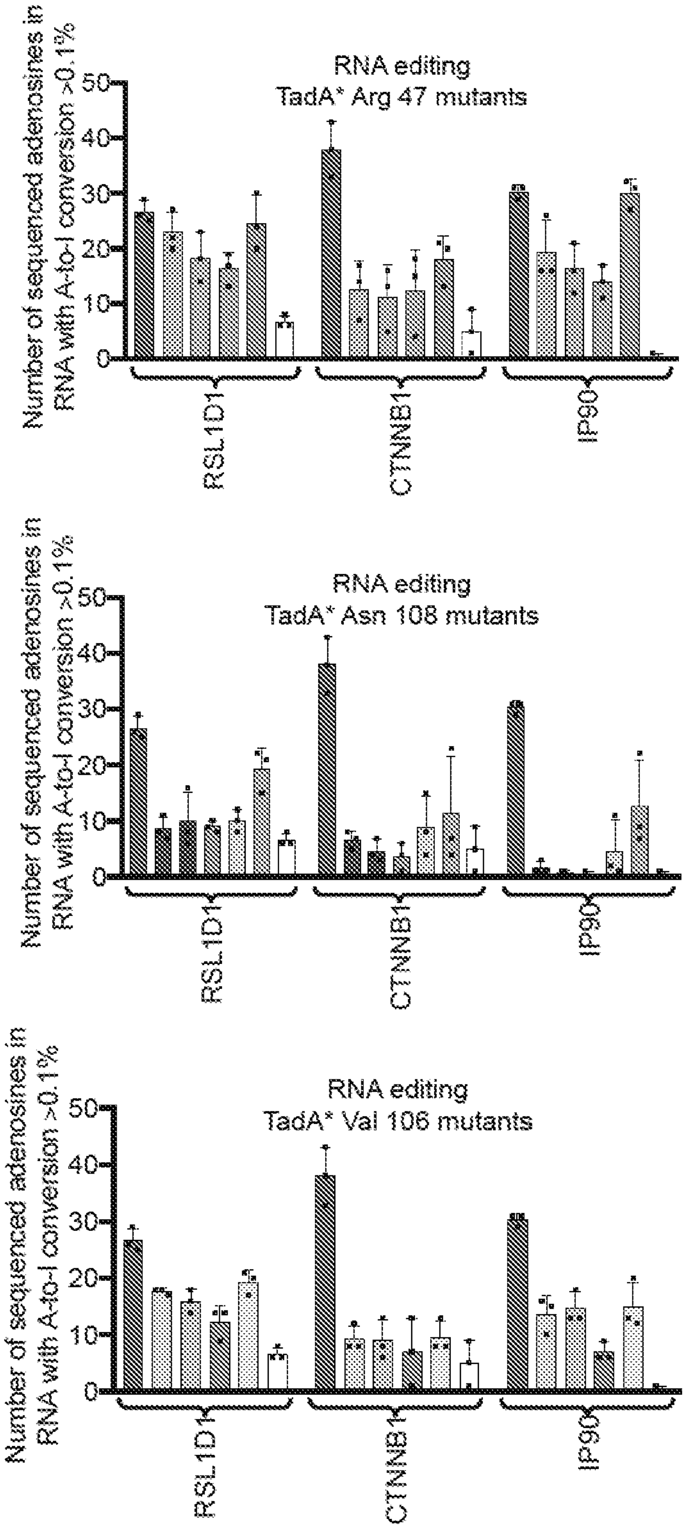
Figure 2F:
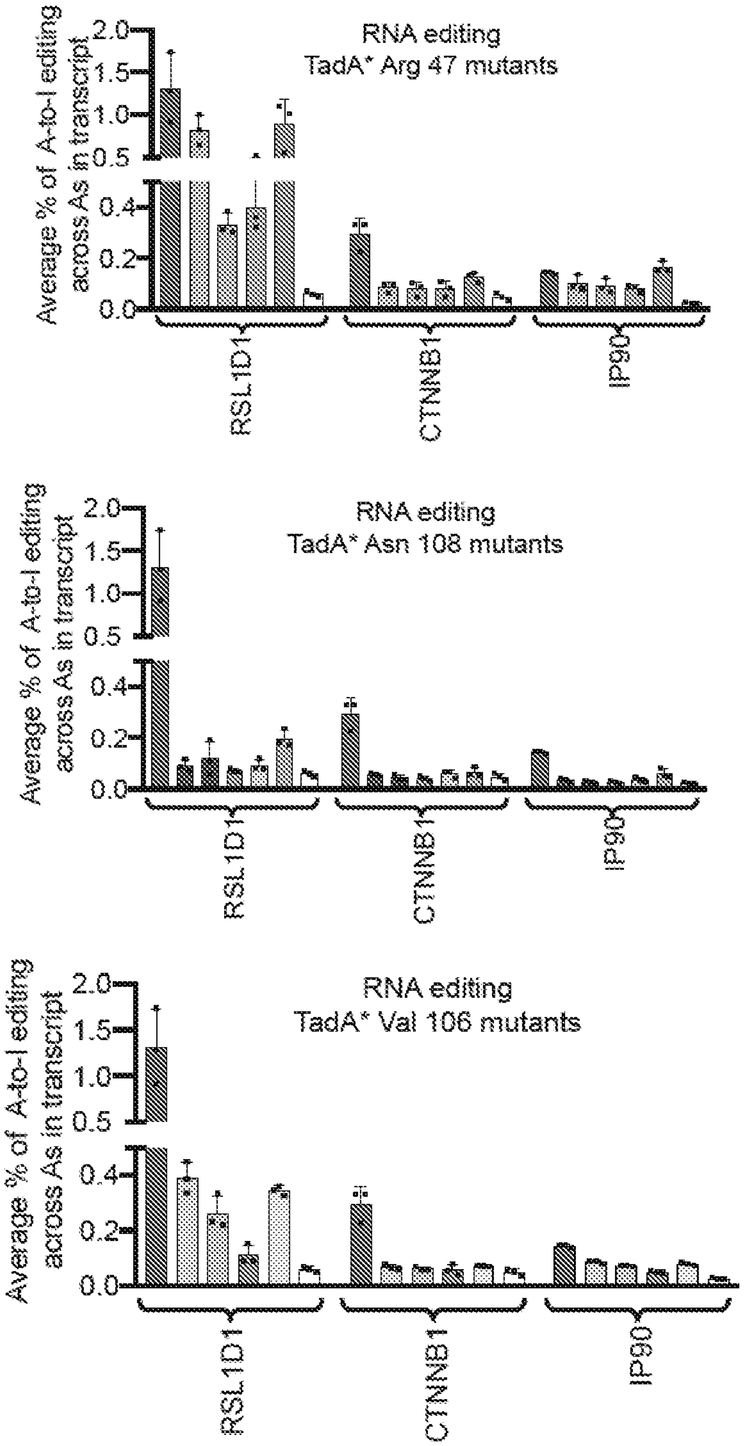

Specifically, the novel ABEmax variants disclosed herein provide average RNA editing frequencies as low as 0.068% (among 182 total adenosines in three analyzed mRNA transcripts), which are levels that approach those observed from a Cas9 nickase-alone control and represent a 7.2-fold reduction relative to the 0.49% average RNA editing frequency of ABEmax (see FIG. 2F). The novel ABEmax variants disclosed herein provide average overall magnitudes of detectable RNA edits among the 182 total adenosines analyzed of as low as 26±10, which is similar to the background of 12±6 for Cas9 nickase alone and significantly reduced from an average of 94±8 with ABEmax (see FIG. 2E). These editing frequencies were analyzed using high-throughput screening (HTS).

Figure 2G:
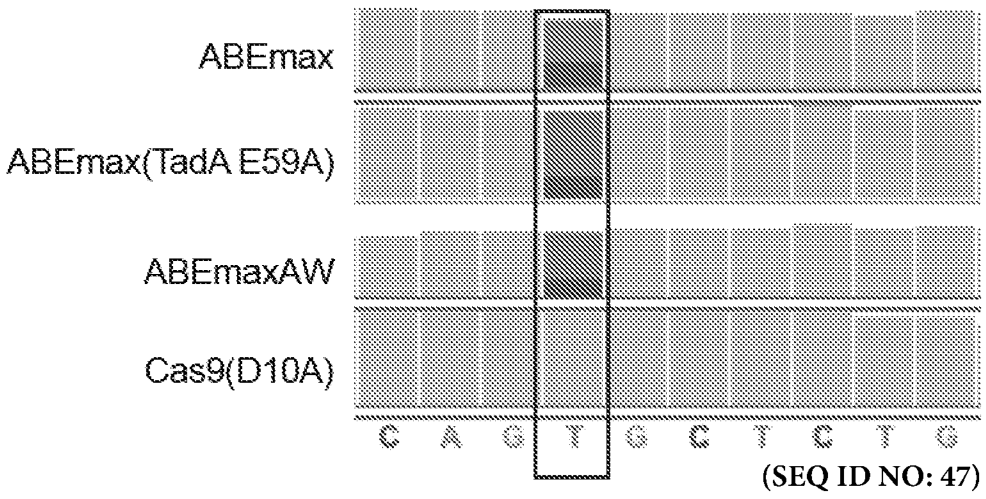
Figure 2H:
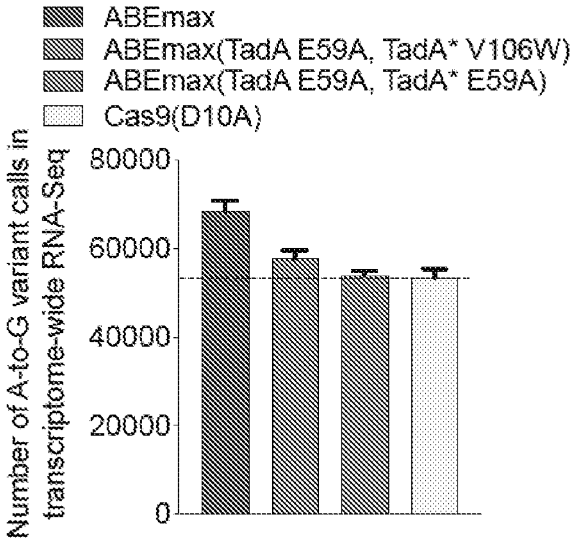

On a human cell transcriptome-wide basis, as analyzed by RNA-seq, the novel ABEmax variants disclosed herein provide average RNA editing frequencies as low as 0.14%, levels nearly equivalent to those observed from Cas9 nickase alone and represent a significant reduction compared with the 0.22% average RNA editing frequency of ABEmax (see FIGS. 2G, 2H). These novel ABEmax variants provide average overall detectable transcriptome edits of about 57,700 edits, levels similar to the background of 53,300 for Cas9 nickase alone and significantly lower (by 10,608 edits) than those ABEmax (see FIG. 2E).

Notably, the disclosed ABEmax variants retain, and in some cases show improved, the high DNA editing fidelity of ABEmax. These variants were shown to generate reduced indel formation (3.7-fold fewer indels) relative to ABEmax at seven target DNA loci, as analyzed by HTS (see FIGS. 4A-4D). These variants generated an average off-target DNA editing frequency as low as 0.79±0.18%, a 2.7-fold improvement relative to ABEmax. These results may indicate an important correlation: Mutations that reduce the tolerance of ABEmax for RNA editing may also increase the DNA specificity of base editing, likely by reducing DNA binding interactions that support productive editing of off-target loci.

Accordingly, in some aspects, the disclosure provides fusion proteins (adenine base editors) that comprise an adenosine deaminase domain (e.g., an adenosine deaminase that deaminates deoxyadenosine in DNA as described herein) and a napDNAbp domain (e.g., a Cas9 protein) capable of binding to a specific nucleotide sequence. Exemplary fusion proteins comprise a Cas9 domain and an adenosine deaminase domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the adenosine deaminase domain comprises a single adenosine deaminase enzyme. In other embodiments, the adenosine deaminase domain comprises two adenosine deaminases, e.g., a heterodimer of adenosine deaminases.

The deamination of an adenosine by an adenosine deaminase can lead to a point mutation, this process is referred to herein as base editing. For example, the adenosine may be converted to an inosine residue, which typically base pairs with a cytosine residue. Such fusion proteins are useful inter alia for targeted editing of nucleic acid sequences. Such fusion proteins may be used for targeted editing of DNA in vitro, e.g., for the generation of mutant cells or animals; for the introduction of targeted mutations, e.g., for the correction of genetic defects in cells ex vivo, e.g., in cells obtained from a subject that are subsequently re-introduced into the same or another subject; and for the introduction of targeted mutations in vivo, e.g., the correction of genetic defects or the introduction of deactivating mutations in disease-associated genes in a subject. As an example, diseases that may be treated by making an A to G, or a T to C mutation, may be treated using the base editors provided herein. Without wishing to be bound by any particular theory certain anemias, such as sickle cell anemia, may be treated by inducing expression of hemoglobin, such as fetal hemoglobin, which is typically silenced in adults. As one example, mutating the thymine to a cytosine at position −198 in the promoter controlling HBG1 and/or HBG2 gene expression results in increased expression of the HBG1 and HBG2 proteins, respectively. Another example, a class of disorders that results from a G to A mutation in a gene is iron storage disorders, where the HFE gene comprises a G to A mutation that results in expression of a C282Y mutant HFE protein. See International Publication No. WO 2019/079347, published Apr. 25, 2019, herein incorporated by reference. Thus, the adenine base editors described herein may be utilized for the targeted editing of such G to A mutations (e.g., targeted genome editing). The disclosure provides deaminases, cells, compositions, methods, kits, systems, etc. that utilize the disclosed deaminases and adenine base editors.

In some embodiments, the adenine base editors provided herein may be made by fusing together one or more protein domains, thereby generating a fusion protein. In certain embodiments, the fusion proteins provided herein comprise one or more features that improve the base editing activity (e.g., efficiency, selectivity, and specificity) of the fusion proteins. For example, the fusion proteins provided herein may comprise a Cas9 domain that has reduced nuclease activity. In some embodiments, the fusion proteins provided herein may have a Cas9 domain that does not have nuclease activity (dCas9), or a Cas9 domain that cuts one strand of a duplexed DNA molecule, referred to as a Cas9 nickase (nCas9). Without wishing to be bound by any particular theory, the presence of the catalytic residue (e.g., H840) maintains the activity of the Cas9 to cleave the non-edited (e.g., non-deaminated) strand containing a T opposite the targeted A. Mutation of the catalytic residue (e.g., D10 to A10) of Cas9 prevents cleavage of the edited strand containing the targeted A residue. Such Cas9 variants are able to generate a single-strand DNA break (nick) at a specific location based on the gRNA-defined target sequence, leading to repair of the non-edited strand, ultimately resulting in a T to C change on the non-edited strand.

The adenosine deaminase domains of the disclosed fusion proteins comprise variants of wild-type deaminase enzymes. These variants comprise an amino acid sequence that is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the wild type enzyme. In some embodiments, the adenosine deaminase domains may comprise an amino acid sequence having 1, 2, 3, 4, 5, 6, 7, 8, 9, 10, 11, 12, 13, 14, 15, 16, 17, 18, 19, 20, 25, 30, or more than 30 amino acids that differ relative to the amino acid sequence of the wild type enzyme. These differences may comprise nucleotides that have been inserted, deleted, or substituted relative to the amino acid sequence of the wild type enzyme. In some embodiments, the adenosine deaminase domains contain stretches of about 50, about 75, about 100, about 125, about 150, about 175, about 200, about 300, about 400, about 500, or more than 500 consecutive amino acids in common with the wild type enzyme. In some embodiments, the adenosine deaminase domains comprise truncations at the N-terminus or C-terminus relative to the wild-type enzyme. In some embodiments, the adenosine deaminase domains comprise truncations of 1, 2, 3, 4, 5, 6, 7, 8, 9, 10, 11, 12, 13, 14, 15, 16, 17, 18, 19, 20, 25, 30, or more than 30 amino acids at the N-terminus or C-terminus relative to the wild-type or base sequence.

Still further, the present disclosure provides for methods of making the adenine base editors, as well as methods of using the base editors or nucleic acid molecules encoding the base editors in applications including editing a nucleic acid molecule, e.g., a genome. The disclosure accordingly provides methods for editing a target nucleic acid molecule, e.g., a single nucleobase within a genome, with a base editing system described herein (e.g., in the form of an evolved base editor as described herein, or a vector or construct encoding same). Such methods involve transducing (e.g., via transfection) cells with a plurality of complexes each comprising a fusion protein (e.g., a fusion protein comprising a napDNAbp (nCas9) domain and an adenosine deaminase domain) and a gRNA molecule. In some embodiments, the gRNA is bound to the napDNAbp domain of the fusion protein. In some embodiments, each gRNA comprises a guide sequence of at least 10 contiguous nucleotides (e.g., 10, 11, 12, 13, 14, 15, 16, 17, 18, 19, 20, 21, 22, 23, 24, 25, 26, 27, 28, 29, or 30 contiguous nucleotides) that is complementary to a target sequence. In certain embodiments, the methods involve the transfection of nucleic acid constructs (e.g., plasmids) that each (or together) encode the components of a complex of fusion protein and gRNA molecule.

In certain embodiments of the disclosed methods, a nucleic acid construct that encodes the fusion protein is transfected into the cell separately from the plasmid that encodes the gRNA molecule. In certain embodiments, these components are encoded on a single construct and transfected together. In other embodiments, the methods disclosed herein involve the introduction into cells of a complex comprising a fusion protein and gRNA molecule that has been expressed and cloned outside of these cells.

It should be appreciated that any fusion protein, e.g., any of the fusion proteins provided herein, may be introduced into the cell in any suitable way, either stably or transiently. In some embodiments, a fusion protein may be transfected into the cell. In some embodiments, the cell may be transduced or transfected with a nucleic acid construct that encodes a fusion protein. For example,e a cell may be transduced (e.g., with a virus encoding a fusion protein), or transfected (e.g., with a plasmid encoding a fusion protein) with a nucleic acid that encodes a fusion protein, or the translated fusion protein. Such transduction may be a stable or transient transduction. In some embodiments, cells expressing a fusion protein or containing a fusion protein may be transduced or transfected with one or more gRNA molecules, for example when the fusion protein comprises a Cas9 (e.g., nCas9) domain. In some embodiments, a plasmid expressing a fusion protein may be introduced into cells through electroporation, transient (e.g., lipofection) and stable genome integration (e.g., piggybac) and viral transduction or other methods known to those of skill in the art.

In certain embodiments, the methods described above result in a cutting (or nicking) one strand of the double-stranded DNA, for example, the strand that includes the thymine (T) of the target A:T nucleobase pair opposite the strand containing the target adenine (A) that is being deaminated. This nicking result serves to direct mismatch repair machinery to the non-edited strand, ensuring that the chemically modified nucleobase is not interpreted as a lesion by the machinery. This nick may be created by the use of an nCas9.

The specification also provides methods for efficiently editing a target nucleic acid molecule, e.g., a single nucleobase of a genome, with a base editing system described herein (e.g., in the form of an base editor as described herein or a vector or construct encoding same), thereby installing an edit. Still further, the disclosure provides therapeutic methods for treating a genetic disease and/or for altering or changing a genetic trait or condition by contacting a target nucleic acid molecule, e.g., a target nucleic acid molecule in the genome of an organism, with a base editing system (e.g., in the form of an base editor protein or a vector encoding same) and conducting base editing to treat the genetic disease and/or change the genetic trait (e.g., eye color).

The target nucleotide sequence may comprise a target sequence (e.g., a point mutation) associated with a disease, disorder, or condition, such as sickle cell anemia. The target sequence may comprise a G to A point mutation associated with a disease, disorder, or condition, and wherein the deamination of the mutant A base results in mismatch repair-mediated correction to a sequence that is not associated with a disease, or disorder, or condition. The target sequence may instead comprise an C to T point mutation associated with a disease, disorder, or condition, and wherein the deamination of the A base that is paired with the mutant T base results in mismatch repair-mediated correction to a sequence that is not associated with a disease, or disorder, or condition. The target sequence may encode a protein, and where the point mutation is in a codon and results in a change in the amino acid encoded by the mutant codon as compared to a wild-type codon. The target sequence may also be at a splice site, and the point mutation results in a change in the splicing of an mRNA transcript as compared to a wild-type transcript. In addition, the target may be at a non-coding sequence of a gene, such as a promoter, and the point mutation results in increased or decreased expression of the gene.

Exemplary target genes include HBG1, HBG2, and HFE, for each of which a sickle cell anemia phenotype is frequently caused by an A:T to G:C point mutation.

In various embodiments, application of the disclosed adenine base editors results in the deamination of a target site. In some cases, the deamination of a mutant A results in a change of the amino acid encoded by the mutant codon, which in some cases can result in the expression of a wild-type amino acid. The application of the base editors can also result in a change of the mRNA transcript, and even restoring the mRNA transcript to a wild-type state.

The methods described herein involving contacting a base editor with a target nucleotide sequence can occur in vitro, ex vivo, or in vivo in a subject. In certain embodiments, the subject has been diagnosed with a disease, disorder, or condition, such as, but not limited to, a disease, disorder, or condition associated with a point mutation in the HBG1 gene, the HBG2 gene, or the HFE gene. The methods described herein involving contacting a base editor with a target nucleotide sequence in the genome of an organism, e.g. a human.

In another aspect, the specification discloses pharmaceutical compositions comprising any of the presently disclosed base editor fusion proteins. In one aspect, the specification discloses a pharmaceutical composition comprising any one of the presently disclosed complexes of fusion proteins and gRNA. In one aspect, the specification discloses a pharmaceutical composition comprising polynucleotides encoding the fusion proteins disclosed herein and polynucleotides encoding a gRNA, or polynucleotides encoding both.

In another aspect, the specification discloses a pharmaceutical composition comprising any one of the presently disclosed vectors. In certain embodiments, the pharmaceutical composition further comprises a pharmaceutically acceptable excipient. In certain embodiments, the pharmaceutical composition further comprises a lipid and/or polymer. In certain embodiments, the lipid and/or polymer is cationic. The preparation of such lipid particles is well known. See, e.g. U.S. Pat. Nos. 4,880,635; 4,906,477; 4,911,928; 4,917,951; 4,920,016; 4,921,757; and 9,737,604, each of which is incorporated herein by reference.

In the examples provided herein, exemplary adenine base editors having the general structure of an evolved fusion protein, such as ecTadA (D108X; X=W, Q, F, K, or M)-XTEN-nCas9, catalyze A to G transition mutations in cells such as eukaryotic cells (e.g., HEK293T mammalian cells). In other examples exemplary adenine base editors contain two ecTadA domains and a nucleic acid programmable DNA binding protein (napDNAbp). The two ecTadA domains may be the same (e.g., a homodimer), or two different ecTadA domains (e.g., a heterodimer of a first adenosine deaminase and a second deaminase (e.g., wild-type ecTadA and ecTadA (A106V/D108W))). For example base editors may have the general structure ecTadA-ecTadA*-nCas9, where ecTadA* represents an evolved ecTadA comprising one or more mutations of SEQ ID NO: 86. Additional examples of base editors containing ecTadA variants provided herein demonstrate an improvement in performance of the base editors in mammalian cells.

Without wishing to be bound by any particular theory, the adenine base editors described herein work by using ecTadA variants to deaminate A bases in DNA, causing adenosine to guanine mutations via inosine formation. Inosine preferentially hydrogen bonds with C, resulting in an A to G mutation during DNA replication. When covalently tethered to Cas9 (or another nucleic acid programmable DNA binding protein), the adenosine deaminase (e.g., ecTadA) is localized to a gene of interest and catalyzes A to G mutations in the ssDNA substrate. This editor may be used to target and revert single nucleotide polymorphisms (SNPs) in disease-relevant genes, which require A to G reversion. This editor can also be used to target and revert single nucleotide polymorphisms (SNPs) in disease-relevant genes, which require T to C reversion by mutating the A, opposite of the T, to a G. The T may then be replaced with a C, for example by base excision repair mechanisms, or may be changed in subsequent rounds of DNA replication. Thus, the adenine base editors described herein may deaminate the A nucleobase to give a nucleotide sequence that is not associated with a disease or disorder. In some aspects, the adenine base editors described herein may be useful for deaminating an adenosine (A) nucleobase in a gene promoter. In some embodiments, deamination leads to induce transcription of the gene. The induction of transcription of a gene leads to an increase in expression of the protein encoded by the gene (e.g., the gene product). A guide RNA (gRNA) bound to the base editor comprises a guide sequence that is complementary to a target nucleic acid sequence in the promoter.

Adenosine Deaminases

The disclosure provides fusion proteins that comprise one or more adenosine deaminases having one or more substitutions in ecTadA, and fusion proteins that comprise one ore more adenosine deaminases having one or more substitutions in TadA7.10. In some aspects, such fusion proteins are capable of deaminating adenosine in a nucleic acid sequence (e.g., DNA or RNA). As one example, any of the fusion proteins provided herein may be base editors (e.g., adenine base editors). In various embodiments, the adenosine deaminases of the disclosed base editors hydrolytically deaminate a targeted adenosine in a nucleic acid of interest to an inosine, which is read as a guanosine (G) by DNA polymerase enzymes. Without wishing to be bound by any particular theory, dimerization of adenosine deaminases (e.g., in cis or in trans) may improve the ability (e.g., efficiency) of the fusion protein to modify a nucleic acid base, for example, to deaminate adenine.

Exemplary, non-limiting, embodiments of adenosine deaminases are provided herein. In some embodiments, the adenosine deaminase domain of any of the disclosed base editors comprises a single adenosine deaminase, or a monomer. In some embodiments, the adenosine deaminase domain comprises 2, 3, 4 or 5 adenosine deaminases. In some embodiments, the adenosine deaminase domain comprises two adenosine deaminases, or a dimer. In some embodiments, the deaminase domain comprises a dimer of an engineered (or evolved) deaminase and a wild-type deaminase, such as a wild-type *E. coli* deaminase. In some embodiments, any of the fusion proteins may comprise 2, 3, 4 or 5 adenosine deaminases. In some embodiments, any of the fusion proteins provided herein comprise two adenosine deaminases. Exemplary, non-limiting, embodiments of adenosine deaminases are provided herein. It should be appreciated that the mutations provided herein (e.g., mutations in ecTadA) may be applied to adenosine deaminases in other adenine base editors, for example those provided in International Publication No. WO 2018/027078, published Aug. 2, 2018; International Publication No. WO 2019/079347, published Apr. 25, 2019; International Application No PCT/US2019/033848, filed May 23, 2019, which published as International Publication No. WO 2019/226593 on Nov. 28, 2019; U.S. Patent Publication No. 2018/0073012, published Mar. 15, 2018, which issued as U.S. Pat. No. 10,113,163, on Oct. 30, 2018; U.S. Patent Publication No. 2017/0121693, published May 4, 2017, which issued as U.S. Pat. No. 10,167,457 on Jan. 1, 2019; International Publication No. WO 2017/070633, published Apr. 27, 2017; U.S. Patent Publication No. 2015/0166980, published Jun. 18, 2015; U.S. Pat. No. 9,840,699, issued Dec. 12, 2017; and U.S. Pat. No. 10,077,453, issued Sep. 18, 2018, all of which are incorporated herein by reference in their entireties.

In some embodiments, any of the adenosine deaminases provided herein are capable of deaminating adenine. In some embodiments, the adenosine deaminases provided herein are capable of deaminating adenine in a deoxyadenosine residue of DNA. The adenosine deaminase may be derived from any suitable organism (e.g., *E. coli*). In some embodiments, the adenosine deaminase is a naturally-occurring adenosine deaminase that includes one or more mutations corresponding to any of the mutations provided herein (e.g., mutations in ecTadA). An amino acid sequence alignment of exemplary TadA deaminases derived from *Bacillus subtilis* (set forth in full as SEQ ID NO: 89), *S. aureus* (SEQ ID NO: 88), and *S. pyogenes* (SEQ ID NO: 110) as compared to the consensus sequence of *E. coli* TadA is provided as FIG. 14. Exemplary amino acid substitutions in the amino acid sequence of *E. coli*)TadA, such as substitutions in amino acid residues 46, 59, 106, or 108, and the homologous mutations in the *B. subtilis, S. aureus*, and *S. pyogenes* TadA deaminases, are shown. Accordingly, one of skill in the art would be able to generate mutations in any naturally-occurring adenosine deaminase (e.g., having homology to ecTadA) that corresponds to any of the mutations described herein, e.g., any of the mutations identified in ecTadA. In some embodiments, the adenosine deaminase is from a prokaryote. In some embodiments, the adenosine deaminase is from a bacterium. In some embodiments, the adenosine deaminase is from *Escherichia coli, Staphylococcus aureus, Streptococcus pyogenes, Salmonella typhi, Shewanella putrefaciens, Haemophilus influenzae, Caulobacter crescentus*, or *Bacillus subtilis*. In some embodiments, the adenosine deaminase is from *E. coli.*

In some embodiments, the adenosine deaminase is a naturally-occurring adenosine deaminase that includes one or more mutations corresponding to any of the mutations provided herein (e.g., mutations in ecTadA). ecTadA natively operates as a homodimer, with one monomer catalyzing deamination, and the other monomer acting as a docking station for the tRNA substrate. In other embodiments, the adenosine deaminase may be modified. Modified adenosine deaminases may be obtained by, e.g., evolving a reference version using targeted mutagenesis, targeted mutagenesis informed by crystallographic structure, or a continuous evolution process (e.g., PACE) described herein so that the deaminase is effective at editing a DNA target. In some embodiments, the adenosine deaminases provided herein are capable of deaminating adenine. In some embodiments, the adenosine deaminases provided herein are capable of deaminating adenine in a deoxyadenosine residue of DNA. Reference is made to International Publication No. WO 2018/027078, published Aug. 2, 2018; International Publication No. WO 2019/079347 published Apr. 25, 2019; International Publication No. WO 2019/226593, published Nov. 28, 2019; U.S. Patent Publication No. 2018/0073012, published Mar. 15, 2018, which issued as U.S. Pat. No. 10,113,163, on Oct. 30, 2018; and U.S. Patent Publication No. 2017/0121693, published May 4, 2017, which issued as U.S. Pat. No. 10,167,457, on Jan. 1, 2019; and Rees & Liu, Base editing: precision chemistry on the genome and transcriptome of living cells, Nat Rev Genet. 2018 December; 19(12):770-788, the disclosures of which are herein incorporated by reference in their entireties. In various embodiments, the deaminase provided herein is a dimer of two adenosine deaminases. In various embodiments, the deaminase provided herein is a homodimer of two TadA deaminases. In various embodiments, the deaminase provided herein is a heterodimer of a wild-type TadA deaminase and an evolved variant of a TadA deaminase. In various embodiments, the deaminase provided herein is a dimer of two adenosine deaminases that is linked covalently or non-covalently to a napDNAbp.

In some embodiments, the adenosine deaminase comprises an amino acid sequence that is at least 60%, at least 65%, at least 70%, at least 75%, at least 80%, at least 85%, at least 90%, at least 95%, at least 96%, at least 97%, at least 98%, at least 99%, or at least 99.5% identical to any one of the amino acid sequences set forth in any one of SEQ ID NOs: 86-107 and 110, or to any of the adenosine deaminases provided herein. It should be appreciated that adenosine deaminases provided herein may include one or more mutations (e.g., any of the mutations provided herein). The disclosure provides adenosine deaminases with a certain percent identiy plus any of the mutations or combinations thereof described herein. In some embodiments, the adenosine deaminase comprises an amino acid sequence tha thas 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 86-107 and 110, or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 86-107 and 110, or any of the adenosine deaminases provided herein.

In some embodiments, the adenosine deaminase comprises a E59X mutation in ecTadA SEQ ID NO: 86, or a corresponding mutation in another adenosine deaminase, where X indicates any amino acid other than the corresponding amino acid in the wild-type adenosine deaminase. In particular embodiments, the adenosine deaminase comprises a E59A mutation in SEQ ID NO: 86, or a corresponding mutation in another adenosine deaminase.

In some embodiments, the adenosine deaminase comprises a D108X mutation in ecTadA SEQ ID NO: 86, or a corresponding mutation in another adenosine deaminase, where X indicates any amino acid other than the corresponding amino acid in the wild-type adenosine deaminase. In some embodiments, the adenosine deaminase comprises a D108W, D108Q, D108F, D108K, or D108M mutation in SEQ ID NO: 86, or a corresponding mutation in another adenosine deaminase. In particular embodiments, the adenosine deaminase comprises a D108W mutation in SEQ ID NO: 86, or a corresponding mutation in another adenosine deaminase. It should be appreciated, however, that additional deaminases may similarly be aligned to identify homologous amino acid residues that may be mutated as provided herein (see FIG. 14).

In some embodiments, the adenosine deaminase comprises an N108W mutation in SEQ ID NO: 96 (TadA7.10), an embodiment also referred to as TadA 7.10 (N108W). Its sequence is provided as SEQ ID NO: 98.

In some embodiments, the adenosine deaminase comprises an A106X mutation in ecTadA SEQ ID NO: 86, or a corresponding mutation in another adenosine deaminase, where X indicates any amino acid other than the corresponding amino acid in the wild-type adenosine deaminase. In some embodiments, the adenosine deaminase comprises an A106V mutation in SEQ ID NO: 86, or a corresponding mutation in another adenosine deaminase. In some embodiments, the adenosine deaminase comprises an A106Q, A106F, A106W, or A106M mutation in SEQ ID NO: 86, or a corresponding mutation in another adenosine deaminase.

In particular embodiments, the adenosine deaminase comprises a V106W mutation in SEQ ID NO: 96, an embodiment also referred to as TadA 7.10 (V106W). Its sequence is provided as SEQ ID NO: 97.

In some embodiments, the adenosine deaminase comprises a R47X mutation in SEQ ID NO: 86, or a corresponding mutation in another adenosine deaminase, where the presence of X indicates any amino acid other than the corresponding amino acid in the wild-type adenosine deaminase. In some embodiments, the adenosine deaminase comprises a R47Q, R47F, R47W, or R47M mutation in SEQ ID NO: 86, or a corresponding mutation in another adenosine deaminase.

In particular embodiments, the adenosine deaminase comprises a R47Q, R47F, R47W, or R47M mutation in SEQ ID NO: 96.

In particular embodiments, the adenosine deaminase comprises a V106Q mutation and an N108W mutation in SEQ ID NO: 96. In particular embodiments, the adenosine deaminase comprises a V106W mutation, an N108W mutation, and an R47Z mutation, wherein Z is selected from the residues consisting of Q, F, W and M, in SEQ ID NO: 86.

It should be appreciated that any of the mutations provided herein (e.g., based on the ecTadA amino acid sequence of SEQ ID NO: 86) may be introduced into other adenosine deaminases, such as *S. aureus* TadA (saTadA), or other adenosine deaminases (e.g., bacterial adenosine deaminases), such as those sequences provided below. See FIG. 14. It would be apparent to the skilled artisan how to identify amino acid residues from other adenosine deaminases that are homologous to the mutated residues in ecTadA. Thus, any of the mutations identified in ecTadA may be made in other adenosine deaminases that have homologous amino acid residues. It should also be appreciated that any of the mutations provided herein may be made individually or in any combination in ecTadA or another adenosine deaminase. For example, an adenosine deaminase may contain a D108N, a A106V, and/or a R47Q mutation in ecTadA SEQ ID NO: 86, or a corresponding mutation in another adenosine deaminase.

In some embodiments, the adenosine deaminase comprises one, two, or three mutations selected from the group consisting of D108, A106, and R47 in SEQ ID NO: 86, or a corresponding mutation or mutations in another adenosine deaminase. In some embodiments, the adenosine deaminase comprises one, two, or three substitutions selected from the group consisting of D108W, A106W, and R47Q in SEQ ID NO: 86, or a corresponding mutation or mutations in another adenosine deaminase. An adenosine deaminase domain comprising TadA(E59W) and TadA7.10(V106W) generated particularly low levels of off-target effects. Another adenosine deaminase domain comprising TadA(E59W) and TadA7.10(N108W) generated particularly low levels of off-target effects.

In other aspects, the disclosure provides adenine base editors with broadened target sequence compatibility. In general, native ecTadA deaminates the adenine in the sequence UAC (e.g., the target sequence) of the anticodon loop of tRNA$^{Arg}$. Without wishing to be bound by any particular theory, in order to expand the utility of ABEs comprising one or more ecTadA deaminases, such as any of the adenosine deaminases provided herein, the adenosine deaminase proteins were optimized to recognize a wide variey of target sequences within the protospacer sequence without compromising the editing efficiency of the adenosine nucleobase editor complex. In some embodiments, the target sequence is an A in the middle of a 5'-NAN-3' sequence, wherein N is T, C, G, or A. In some embodiments, the target sequence comprises 5'-TAC-3'. In some embodiments, the target sequence comprises 5'-GAA-3'.

In some embodiments, the adenosine deaminase is an N-terminal truncated *E. coli* TadA. In certain embodiments, the adenosine deaminase comprises the amino acid sequence:

```
                                        (SEQ ID NO: 86)
MSEVEFSHEYWMRHALTLAKRAWDEREVPVGAVLVHNNRVIGEGWNRPI

GRHDPTAHAEIMALRQGGLVMQNYRLIDATLYVTLEPCVMCAGAMIFIS

RIGRVVFGARDAKTGAAGSLMDVLHHPGMNHRVEITEGILADECAALLS

DFFRMRRQEIKAQKKAQSSTD.
```

In some embodiments, the TadA deaminase is a full-length *E. coli* TadA deaminase (ecTadA). For example, in certain embodiments, the adenosine deaminase comprises the amino acid sequence:

```
                                        (SEQ ID NO: 87)
MRRAFITGVFFLSEVEFSHEYWMRHALTLAKRAWDEREVPVGAVLVHNN

RVIGEGWNRPIGRHDPTAHAEIMALRQGGLVMQNYRLIDATLYVTLEPC

VMCAGAMIHSRIGRVVFGARDAKTGAAGSLMDVLHHPGMNHRVEITEGI

LADECAALLSDFFRMRRQEIKAQKKAQSSTD
```

It should be appreciated, however, that additional adenosine deaminases useful in the present application would be apparent to the skilled artisan and are within the scope of this disclosure. For example, the adenosine deaminase may be a homolog of an ADAT. Exemplary ADAT homologs include, without limitation:

*Staphylococcus aureus* TadA:

```
                                        (SEQ ID NO: 88)
MGSHMTNDIYFMTLAIEEAKKAAQLGEVPIGAIITKDDEVIARAHNLRE

TLQQPTAHAEHIAIERAAKVLGSWRLEGCTLYVTLEPCVMCAGTIVMSR

IPRVVYGADDPKGGCSGSLMNLLQQSNFNHRAIVDKGVLKEACSTLLTT

FFKNLRANKKSTN
```

*Bacillus subtilis* TadA:

```
                                        (SEQ ID NO: 89)
MTQDELYMKEAIKEAKKAEEKGEVPIGAVLVINGEIIARAHNLRETEQR

SIAHAEMLVIDEACKALGTWRLEGATLYVTLEPCPMCAGAVVLSRVEKV

VFGAFDPKGGCSGTLMNLLQEERFNHQAEVVSGVLEEECGGMLSAFFRE

LRKKKKAARKNLSE
```

-continued

*Salmonella typhimurium* (*S. typhimurium*) TadA:

```
                                        (SEQ ID NO: 90)
MPPAFITGVTSLSDVELDHEYWMRHALTLAKRAWDEREVPVGAVLVHNH

RVIGEGWNRPIGRHDPTAHAEIMALRQGGLVLQNYRLLDTTLYVTLEPC

VMCAGAMVHSRIGRVVFGARDAKTGAAGSLIDVLHHPGMNHRVEIIEGV

LRDECATLLSDFFRMRRQEIKALKKADRAEGAGPAV
```

*Shewanella putrefaciens* (*S. putrefaciens*) TadA:

```
                                        (SEQ ID NO: 91)
MDEYWMQVAMQMAEKAEAAGEVPVGAVLVKDGQQIATGYNLSISQHDPT

AHAEILCLRSAGKKLENYRLLDATLYITLEPCAMCAGAMVHSRIARVVY

GARDEKTGAAGTVVNLLQHPAFNHQVEVTSGVLAEACSAQLSRFFKRRR

DEKKALKLAQRAQQGIE
```

*Haemophilus influenzae* F3031 (*H. influenzae*) TadA:

```
                                        (SEQ ID NO: 92)
MDAAKVRSEFDEKMMRYALELADKAEALGEIPVGAVLVDDARNIIGEGW

NLSIVQSDPTAHAEIIALRNGAKNIQNYRLLNSTLYVTLEPCTMCAGAI

LHSRIKRLVFGASDYKTGAIGSRFHFFDDYKMNHTLEITSGVLAEECSQ

KLSTFFQKRREEKKIEKALLKSLSDK
```

*Caulobacter crescentus* (*C. crescentus*) TadA:

```
                                        (SEQ ID NO: 93)
MRTDESEDQDHRMMRLALDAARAAAEAGETPVGAVILDPSTGEVIATAG

NGPIAAHDPTAHAEIAAMRAAAAKLGNYRLTDLTLVVTLEPCAMCAGAI

SHARIGRVVFGADDPKGGAVVHGPKFFAQPTCHWRPEVTGGVLADESAD

LLRGFFRARRKAKI
```

*Geobacter sulfurreducens* (*G. sulfurreducens*) TadA:

```
                                        (SEQ ID NO: 94)
MSSLKKTPIRDDAYWMGKAIREAAKAAARDEVPIGAVIVRDGAVIGRGH

NLREGSNDPSAHAEMIAIRQAARRSANWRLTGATLYVTLEPCLMCMGAI

ILARLERVVFGCYDPKGGAAGSLYDLSADPRLNHQVRLSPGVCQEECGT

MLSDFFRDLRRRKKAKATPALFIDERKVPPEP
```

*Streptococcus pyogenes* (*S. pyogenes*) TadA

```
                                       (SEQ ID NO: 110)
MPYSLEEQTYFMQEALKEAEKSLQKAEIPIGCVIVKDGEIIGRGHNARE

ESNQAIMHAEIMAINEANAHEGNWRLLDTTLFVTIEPCVMCSGAIGLAR

IPHVIYGASNQKFGGADSLYQILTDERLNHRVQVERGLLAADCANIMQT

FFRQGRERKKIAKHLIKEQSDPFD
```

Exemplary adenosine deaminase variants of the disclosure are described below. In certain embodiments, the adenosine deaminase has a sequence with at least 80%, at least 85%, at least 90%, at least 95%, at least 98%, at least 99%, or at least 99.5% sequence identity to one of the following:

(Ec)TadA, catalytically inactive (E59A)

```
                                        (SEQ ID NO: 95)
MSEVEFSHEYWMRHALTLAKRAWDEREVPVGAVLVHNNRVIGEGWNRPI

GRHDPTAHAAIMALRQGGLVMQNYRLIDATLYVTLEPCVMCAGAMIHSR

IGRVVFGARDAKTGAAGSLMDVLHHPGMNHRVEITEGILADECAALLSD

FFRMRRQEIKAQKKAQSSTD
```

-continued

TadA 7.10
(SEQ ID NO: 96)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD

TadA 7.10 (V106W)
(SEQ ID NO: 97)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGWRNAKTGAAGSLMDVLHYPGMNHRVEITEGILADECAALLCY
FFRMPRQVFNAQKKAQSSTD

TadA 7.10 (N108W)
(SEQ ID NO: 98)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRWAKTGAAGSLMDVLHYPGMNHRVEITEGILADECAALLCY
FFRMPRQVFNAQKKAQSSTD

TadA 7.10 (N108Q)
(SEQ ID NO: 99)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGVRQAKTGAAGSLMDVLHYPGMNHRVEITEGILADECAALLCY
FFRMPRQVFNAQKKAQSSTD

TadA 7.10 (V106F)
(SEQ ID NO: 100)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGFRNAKTGAAGSLMDVLHYPGMNHRVEITEGILADECAALLCY
FFRMPRQVFNAQKKAQSSTD

TadA 7.10 (V106Q)
(SEQ ID NO: 101)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGQRNAKTGAAGSLMDVLHYPGMNHRVEITEGILADECAALLCY
FFRMPRQVFNAQKKAQSSTD

TadA 7.10 (V106M)
(SEQ ID NO: 102)
MSEVEFSHEYWMRHALTLAKRARDEREVPVGAVLVLNNRVIGEGWNRAI
GLHDPTAHAEIMALRQGGLVMQNYRLIDATLYVTFEPCVMCAGAMIHSR
IGRVVFGMRNAKTGAAGSLMDVLHYPGMNHRVEITEGILADECAALLCY
FFRMPRQVFNAQKKAQSSTD

TadA 7.10 (R47F)
(SEQ ID NO: 103)
MSEVEFSHEYWMRHALTLAKRARDEREVPVGAVLVLNNRVIGEGWNFAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD

-continued

TadA 7.10 (R47W)
(SEQ ID NO: 104)
MSEVEFSHEYWMRHALTLAKRARDEREVPVGAVLVLNNRVIGEGWNWAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD

TadA 7.10 (R47Q)
(SEQ ID NO: 105)
MSEVEFSHEYWMRHALTLAKRARDEREVPVGAVLVLNNRVIGEGWNQAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD

TadA 7.10 (R47M)
(SEQ ID NO: 106)
MSEVEFSHEYWMRHALTLAKRARDEREVPVGAVLVLNNRVIGEGWNMAI
GLHDPTAHAEIMALRQGGLVMQNYRLIDATLYVTFEPCVMCAGAMIHSR
IGRVVFGVRNAKTGAAGSLMDVLHYPGMNHRVEITEGILADECAALLCY
FFRMPRQVFNAQKKAQSSTD

TadA (E59Q)
(SEQ ID NO: 107)
MSEVEFSHEYWMRHALTLAKRAWDEREVPVGAVLVHNNRVIGEGWNRPI
GRHDPTAHAQIMALRQGGLVMQNYRLIDATLYVTLEPCVMCAGAMIHSR
IGRVVFGARDAKTGAAGSLMDVLHHPGMNHRVEITEGILADECAALLSD
FFRMRRQEIKAQKKAQSSTD

Any two or more of the adenosine deaminases described herein may be connected to one another (e.g. by a linker) within an adenosine deaminase domain of the fusion proteins provided herein. For instance, the fusion proteins provided herein may contain only two adenosine deaminases. In some embodiments, the adenosine deaminases are the same. In some embodiments, the adenosine deaminases are any of the adenosine deaminases provided herein. In some embodiments, the adenosine deaminases are different. In some embodiments, the first adenosine deaminase is any of the adenosine deaminases provided herein, and the second adenosine is any of the adenosine deaminases provided herein, but is not identical to the first adenosine deaminase. In some embodiments, the fusion protein comprises two adenosine deaminases (e.g., a first adenosine deaminase and a second adenosine deaminase). In some embodiments, the fusion protein comprises a first adenosine deaminase and a second adenosine deaminase. In some embodiments, the first adenosine deaminase is N-terminal to the second adenosine deaminase in the fusion protein. In some embodiments, the first adenosine deaminase is C-terminal to the second adenosine deaminase in the fusion protein. In some embodiments, the first adenosine deaminase and the second deaminase are fused directly or via a linker.

In particular embodiments, the base editors disclosed herein comprise a heterodimer of a first adenosine deaminase that is N-terminal to a second adenosine deaminase, wherein the first adenosine deaminase comprises a sequence with at least 80%, 85%, 90%, 95%, 98%, 99%, or 99.5% sequence identity to SEQ ID NO: 95; and the second adenosine deaminase comprises a sequence with at least 80%, 85%, 90%, 95%, 98%, 99%, or 99.5% sequence identity to SEQ ID NO: 97.

In other embodiments, the second adenosine deaminase of the base editors provided herein comprises a sequence with at least 80%, 85%, 90%, 95%, 98%, 99%, or 99.5% sequence identity to SEQ ID NO: 96 (TadA 7.10), wherein any sequence variation may only occur in amino acid positions other than R47, V106 or N108 of SEQ ID NO: 96. In other words, these embodiments must contain amino acid substitutions at R47, V106 or N108 of SEQ ID NO: 96.

In other embodiments, the second adenosine deaminase of the heterodimer comprises a sequence with at least 80%, 85%, 90%, 95%, 98%, 99%, or 99.5% sequence identity to SEQ ID NO: 107. In other embodiments, second adenosine deaminase comprises a sequence with at least 80%, 85%, 90%, 95%, 98%, 99%, or 99.5% sequence identity to SEQ ID NOs: 98 or 99. In other embodiments, second adenosine deaminase comprises a sequence with at least 80%, 85%, 90%, 95%, 98%, 99%, or 99.5% sequence identity to a sequence selected from SEQ ID NOs: 100-102. In other embodiments, second adenosine deaminase comprises a sequence with at least 80%, 85%, 90%, 95%, 98%, 99%, or 99.5% sequence identity to a sequence selected from SEQ ID NOs: 103-106. In some embodiments, the adenosine deaminase comprises an amino acid sequence that has 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more mutations compared to any one of the amino acid sequences set forth in SEQ ID NOs: 96-107, and 110 (e.g., TadA7.10), or any of the adenosine deaminases provided herein. In some embodiments, the adenosine deaminase comprises an amino acid sequence that has at least 5, at least 10, at least 15, at least 20, at least 25, at least 30, at least 35, at least 40, at least 45, at least 50, at least 60, at least 70, at least 80, at least 90, at least 100, at least 110, at least 120, at least 130, at least 140, at least 150, at least 160, or at least 170 identical contiguous amino acid residues as compared to any one of the amino acid sequences set forth in SEQ ID NOs: 96-107 and 110 (e.g., TadA7.10), or any of the adenosine deaminases provided herein.

napDNAbp Domains

The adenine base editors described herein comprise a nucleic acid programmable DNA binding (napDNAbp) domain. The napDNAbp is associated with at least one guide nucleic acid (e.g., guide RNA), which localizes the napDNAbp to a DNA sequence that comprises a DNA strand (i.e., a target strand) that is complementary to the guide nucleic acid, or a portion thereof (e.g., the protospacer of a guide RNA). In other words, the guide nucleic-acid "programs" the napDNAbp domain to localize and bind to a complementary sequence of the target strand. Binding of the napDNAbp domain to a complementary sequence enables the nucleobase modification domains (e.g., adenosine deaminase domain) of the base editor to access and enzymatically deaminate a target adenine base in the target strand.

The napDNAbp domain can be a CRISPR (clustered regularly interspaced short palindromic repeat)-associated nuclease. As outlined above, CRISPR is an adaptive immune system that provides protection against mobile genetic elements (viruses, transposable elements and conjugative plasmids). CRISPR clusters contain spacers, sequences complementary to antecedent mobile elements, and target invading nucleic acids. CRISPR clusters are transcribed and processed into CRISPR RNA (crRNA). In type II CRISPR systems correct processing of pre-crRNA requires a trans-encoded small RNA (tracrRNA), endogenous ribonuclease 3 (rnc) and a Cas9 protein. The tracrRNA serves as a guide for ribonuclease 3-aided processing of pre-crRNA. Subsequently, Cas9/crRNA/tracrRNA endonucleolytically cleaves linear or circular dsDNA target complementary to the spacer. The target strand not complementary to crRNA is first cut endonucleolytically, then trimmed 3'-5' exonucleolytically. In nature, DNA-binding and cleavage typically requires protein and both RNAs. However, single guide RNAs ("sgRNA", or simply "gNRA") can be engineered so as to incorporate aspects of both the crRNA and tracrRNA into a single RNA species. See, e.g., Jinek et al., Science 337:816-821(2012), the entire contents of which is hereby incorporated by reference.

Without wishing to be bound by any particular theory, the binding mechanism of a napDNAbp—guide RNA complex, in general, includes the step of forming an R-loop whereby the napDNAbp induces the unwinding of a double-strand DNA target, thereby separating the strands in the region bound by the napDNAbp. The guideRNA protospacer then hybridizes to the "target strand." This displaces a "non-target strand" that is complementary to the target strand, which forms the single strand region of the R-loop. In some embodiments, the napDNAbp includes one or more nuclease activities, which cuts the DNA leaving various types of lesions (e.g., a nick in one strand of the DNA). For example, the napDNAbp may comprises a nuclease activity that cuts the non-target strand at a first location, and/or cuts the target strand at a second location. Depending on the nuclease activity, the target DNA can be cut to form a "double-stranded break" whereby both strands are cut. In other embodiments, the target DNA can be cut at only a single site, i.e., the DNA is "nicked" on one strand.

The below description of various napDNAbps which can be used in connection with the disclosed nucleobase modification domains (adenosine deaminase domains) is not meant to be limiting in any way. The base editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolution or otherwise mutagenic process. In various embodiments, the napDNAbp has a nickase activity, i.e., only cleave one strand of the target DNA sequence. In other embodiments, the napDNAbp has an inactive nuclease, e.g., are "dead" proteins. Other variant Cas9 proteins that may be used are those having a smaller molecular weight than the canonical SpCas9 (e.g., for easier delivery) or having modified or rearranged primary amino acid sequence (e.g., the circular permutant forms). The base editors described herein may also comprise Cas9 equivalents, including Cas12a/Cpf1 and Cas12b proteins. The napDNAbps used herein (e.g., an SpCas9 or SpCas9 variant) may also may also contain various modifications that alter/enhance their PAM specifities. The disclosure contemplates any Cas9, Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a reference SpCas9 canonical sequence (set forth in SEQ ID NO: 141), a reference SaCas9 canonical sequence (set forth in SEQ ID NO: 127) or a reference Cas9 equivalent (e.g., Cas12a/Cpf1).

In some embodiments, the napDNAbp directs cleavage of one or both strands at the location of a target sequence, such as within the target sequence and/or within the complement of the target sequence. In some embodiments, the napDNAbp directs cleavage of one or both strands within about 1, 2, 3, 4, 5, 6, 7, 8, 9, 10, 15, 20, 25, 50, 100, 200, 500, or more base pairs from the first or last nucleotide of a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A in reference to the canonical SpCas9 sequence, or to equivalent amino acid positions in other Cas9 variants or Cas9 equivalents.

As used herein, the term "Cas protein" refers to a full-length Cas protein obtained from nature, a recombinant Cas protein having a sequences that differs from a naturally occurring Cas protein, or any fragment of a Cas protein that nevertheless retains all or a significant amount of the requisite basic functions needed for the disclosed methods, i.e., (i) possession of nucleic-acid programmable binding of the Cas protein to a target DNA, and (ii) ability to nick the target DNA sequence on one strand. The Cas proteins contemplated herein embrace CRISPR Cas9 proteins, as well as Cas9 equivalents, variants (e.g., Cas9 nickase (nCas9) or nuclease inactive Cas9 (dCas9)) homologs, orthologs, or paralogs, whether naturally occurring or non-naturally occurring (e.g., engineered or recombinant), and may include a Cas9 equivalent from any type of CRISPR system (e.g., type II, V, VI), including Cpf1 (a type-V CRISPR-Cas systems), C2c1 (a type V CRISPR-Cas system), C2c2 (a type VI CRISPR-Cas system) and C2c3 (a type V CRISPR-Cas system). Further Cas-equivalents are described in Makarova et al., "C2c2 is a single-component programmable RNA-guided RNA-targeting CRISPR effector," Science 2016; 353(6299), the contents of which are incorporated herein by reference.

The term "Cas9" or "Cas9 domain" embraces any naturally occurring Cas9 from any organism, any naturally-occurring Cas9 equivalent or functional fragment thereof, any Cas9 homolog, ortholog, or paralog from any organism, and any mutant or variant of a Cas9, naturally-occurring or engineered. The term Cas9 is not meant to be particularly limiting and may be referred to as a "Cas9 or equivalent." Exemplary Cas9 proteins are further described herein and/or are described in the art and are incorporated herein by reference. The present disclosure is unlimited with regard to the particular napDNAbp that is employed in the base editors of the disclosure.

Additional Cas9 sequences and structures are well known to those of skill in the art (see, e.g., "Complete genome sequence of an M1 strain of *Streptococcus pyogenes*." Ferretti et al., J. J., McShan W. M., Ajdic D. J., Savic D. J., Savic G., Lyon K., Primeaux C., Sezate S., Suvorov A. N., Kenton S., Lai H. S., Lin S. P., Qian Y., Jia H. G., Najar F. Z., Ren Q., Zhu H., Song L., White J., Yuan X., Clifton S. W., Roe B. A., McLaughlin R. E., Proc. Natl. Acad. Sci. U.S.A. 98:4658-4663(2001); "CRISPR RNA maturation by trans-encoded small RNA and host factor RNase III." Deltcheva E., Chylinski K., Sharma C. M., Gonzales K., Chao Y., Pirzada Z. A., Eckert M. R., Vogel J., Charpentier E., Nature 471:602-607(2011); and "A programmable dual-RNA-guided DNA endonuclease in adaptive bacterial immunity." Jinek M., Chylinski K., Fonfara I., Hauer M., Doudna J. A., Charpentier E. Science 337:816-821(2012), the entire contents of each of which are incorporated herein by reference), and also provided below.

Examples of Cas9 and Cas9 equivalents are provided as follows; however, these specific examples are not meant to be limiting. The base editors of the present disclosure may use any suitable napDNAbp, including any suitable Cas9 or Cas9 equivalent.

Wild Type Canonical SpCas9

In one embodiment, the base editor constructs described herein may comprise the "canonical SpCas9" nuclease from *S. pogenes*, which has been widely used as a tool for genome engineering. This Cas9 protein is a large, multi-domain protein containing two distinct nuclease domains. Point mutations can be introduced into Cas9 to abolish one or both nuclease activities, resulting in a nickase Cas9 (nCas9) or dead Cas9 (dCas9), respectively, that still retains its ability to bind DNA in a sgRNA-programmed manner. In principle, when fused to another protein or domain, Cas9 or variant thereof (e.g., nCas9) can target that protein to virtually any DNA sequence simply by co-expression with an appropriate sgRNA. As used herein, the canonical SpCas9 protein refers to the wild type protein from *Streptococcus pyogenes* having the following amino acid sequence:

| Description | Sequence | SEQ ID NO: |
|---|---|---|
| SpCas9 *Streptococcus pyogenes* M1 Swiss Prot Accession No. Q99ZW2 Wild type | MDKKYSIGLDIGTNSVGWAVITDEYKVPSKKFKVLGN<br>TDRHSIKKNLIGALLFDSGETAEATRLKRTARRRYTRR<br>KNRICYLQEIFSNEMAKVDDSFFHRLEESFLVEEDKKH<br>ERHPIFGNIVDEVAYHEKYPTIYHLRKKLVDSTDKADL<br>RLIYLALAHMIKFRGHFLIEGDLNPDNSDVDKLFIQLVQ<br>TYNQLFEENPINASGVDAKAILSARLSKSRRLENLIAQL<br>PGEKKNGLFGNLIALSLGLTPNFKSNFDLAEDAKLQLS<br>KDTYDDDLDNLLAQIGDQYADLFLAAKNLSDAILLSDI<br>LRVNTEITKAPLSASMIKRYDEHHQDLTLLKALVRQQL<br>PEKYKEIFFDQSKNGYAGYIDGGASQEEFYKFIKPILEK<br>MDGTEELLVKLNREDLLRKQRTFDNGSIPHQIHLGELH<br>AILRRQEDFYPFLKDNREKIEKILTFRIPYYVGPLARGN<br>SRFAWMTRKSEETITPWNFEEVVDKGASAQSFIERMTN<br>FDKNLPNEKVLPKHSLLYEYFTVYNELTKVKYVTEGM<br>RKPAFLSGEQKKAIVDLLFKTNRKVTVKQLKEDYFKKI<br>ECFDSVEISGVEDRFNASLGTYHDLLKIIKDKDFLDNEE<br>NEDILEDIVLTLTLFEDREMIEERLKTYAHLFDDKVMK<br>QLKRRRYTGWGRLSRKLINGIRDKQSGKTILDFLKSDG<br>FANRNFMQLIHDDSLTFKEDIQKAQVSGQGDSLHEHIA<br>NLAGSPAIKKGILQTVKVVDELVKVMGRHKPENIVIEM<br>ARENQTTQKGQKNSRERMKRIEEGIKELGSQILKEHPV<br>ENTQLQNEKLYLYYLQNGRDMYVDQELDINRLSDYD<br>VDHIVPQSFLKDDSIDNKVLTRSDKNRGKSDNVPSEEV<br>VKKMKNYWRQLLNAKLITQRKFDNLTKAERGGLSEL<br>DKAGFIKRQLVETRQITKHVAQILDSRMNTKYDENDK<br>LIREVKVITLKSKLVSDFRKDFQFYKVREINNYHHAHD<br>AYLNAVVGTALIKKYPKLESEFVYGDYKVYDVRKMIA | SEQ ID NO: 141 |

-continued

| Description | Sequence | SEQ ID NO: |
|---|---|---|
| | KSEQEIGKATAKYFFYSNIMNFFKTEITLANGEIRKRPLI<br>ETNGETGEIVWDKGRDFATVRKVLSMPQVNIVKKTEV<br>QTGGFSKESILPKRNSDKLIARKKDWDPKKYGGFDSPT<br>VAYSVLVVAKVEKGKSKKLKSVKELLGITIMERSSFEK<br>NPIDFLEAKGYKEVKKDLIIKLPKYSLFELENGRKRML<br>ASAGELQKGNELALPSKYVNFLYLASHYEKLKGSPED<br>NEQKQLFVEQHKHYLDEIIEQISEFSKRVILADANLDKV<br>LSAYNKHRDKPIREQAENIIHLFTLTNLGAPAAFKYFDT<br>TIDRKRYTSTKEVLDATLIHQSITGLYETRIDLSQLGGD | |
| SpCas9<br>Reverse<br>translation<br>of<br>SwissProt<br>Accession<br>No.<br>Q99ZW2<br>*Streptococcus*<br>*pyogenes* | ATGGATAAAAAATATAGCATTGGCCTGGATATTGGC<br>ACCAACAGCGTGGGCTGGGCGGTGATTACCGATGAA<br>TATAAAGTGCCGAGCAAAAAATTTAAAGTGCTGGGC<br>AACACCGATCGCCATAGCATTAAAAAAAACCTGATT<br>GGCGCGCTGCTGTTTGATAGCGGCGAAACCGCGGAA<br>GCGACCCGCCTGAAACGCACCGCGCGCCGCCGCTAT<br>ACCCGCCGCAAAAACCGCATTTGCTATCTGCAGGAA<br>ATTTTTAGCAACGAAATGGCGAAAGTGGATGATAGC<br>TTTTTTCATCGCCTGGAAGAAAGCTTTCTGGTGGAAG<br>AAGATAAAAAACATGAACGCCATCCGATTTTTGGCA<br>ACATTGTGGATGAAGTGGCGTATCATGAAAAATATC<br>CGACCATTTATCATCTGCGCAAAAAACTGGTGGATA<br>GCACCGATAAAGCGGATCTGCGCCTGATTTATCTGG<br>CGCTGGCGCATATGATTAAATTTCGCGGCCATTTTCT<br>GATTGAAGGCGATCTGAACCCGGATAACAGCGATGT<br>GGATAAACTGTTTATTCAGCTGGTGCAGACCTATAA<br>CCAGCTGTTTGAAGAAAACCCGATTAACGCGAGCGG<br>CGTGGATGCGAAAGCGATTCTGAGCGCGCGCCTGAG<br>CAAAAGCCGCCGCCTGGAAAACCTGATTGCGCAGCT<br>GCCGGGCGAAAAAAAAAACGGCCTGTTTGGCAACCT<br>GATTGCGCTGAGCCTGGGCCTGACCCCGAACTTTAA<br>AAGCAACTTTGATCTGGCGGAAGATGCGAAACTGCA<br>GCTGAGCAAAGATACCTATGATGATGATCTGGATAA<br>CCTGCTGGCGCAGATTGGCGATCAGTATGCGGATCT<br>GTTTCTGGCGGCGAAAAACCTGAGCGATGCGATTCT<br>GCTGAGCGATATTCTGCGCGTGAACACCGAAATTAC<br>CAAAGCGCCGCTGAGCGCGAGCATGATTAAACGCTA<br>TGATGAACATCATCAGGATCTGACCCTGCTGAAAGC<br>GCTGGTGCGCCAGCAGCTGCCGGAAAAATATAAAG<br>AAATTTTTTTTGATCAGAGCAAAAACGGCTATGCGG<br>GCTATATTGATGGCGGCGCGAGCCAGGAAGAATTTT<br>ATAAATTTATTAAACCGATTCTGGAAAAAATGGATG<br>GCACCGAAGAACTGCTGGTGAAACTGAACCGCGAA<br>GATCTGCTGCGCAAACAGCGCACCTTTGATAACGGC<br>AGCATTCCGCATCAGATTCATCTGGGCGAACTGCAT<br>GCGATTCTGCGCCGCCAGGAAGATTTTTATCCGTTTC<br>TGAAAGATAACCGCGAAAAAATTGAAAAAATTCTG<br>ACCTTTCGCATTCCGTATTATGTGGGCCCGCTGGCGC<br>GCGGCAACAGCCGCTTTGCGTGGATGACCCGCAAAA<br>GCGAAGAAACCATTACCCCGTGGAACTTTGAAGAAG<br>TGGTGGATAAAGGCGCGAGCGCGCAGAGCTTTATTG<br>AACGCATGACCAACTTTGATAAAAACCTGCCGAACG<br>AAAAAGTGCTGCCGAAACATAGCCTGCTGTATGAAT<br>ATTTTACCGTGTATAACGAACTGACCAAAGTGAAAT<br>ATGTGACCGAAGGCATGCGCAAACCGGCGTTTCTGA<br>GCGGCGAACAGAAAAAAGCGATTGTGGATCTGCTGT<br>TTAAAACCAACCGCAAAGTGACCGTGAAACAGCTGA<br>AAGAAGATTATTTTAAAAAAATTGAATGCTTTGATA<br>GCGTGGAAATTAGCGGCGTGGAAGATCGCTTTAACG<br>CGAGCCTGGGCACCTATCATGATCTGCTGAAAATTA<br>TTAAAGATAAAGATTTTCTGGATAACGAAGAAAACG<br>AAGATATTCTGGAAGATATTGTGCTGACCCTGACCC<br>TGTTTGAAGATCGCGAAATGATTGAAGAACGCCTGA<br>AAACCTATGCGCATCTGTTTGATGATAAAGTGATGA<br>AACAGCTGAAACGCCGCCGCTATACCGGCTGGGGCC<br>GCCTGAGCCGCAAACTGATTAACGGCATTCGCGATA<br>AACAGAGCGGCAAAACCATTCTGGATTTTCTGAAAA<br>GCGATGGCTTTGCGAACCGCAACTTTATGCAGCTGA<br>TTCATGATGATAGCCTGACCTTTAAAGAAGATATTC<br>AGAAAGCGCAGGTGAGCGGCCAGGGCGATAGCCTG<br>CATGAACATATTGCGAACCTGGCGGGCAGCCCGGCG<br>ATTAAAAAAGGCATTCTGCAGACCGTGAAAGTGGTG<br>GATGAACTGGTGAAAGTGATGGGCCGCCATAAACCG<br>GAAAACATTGTGATTGAAATGGCGCGCGAAAACCA<br>GACCACCCAGAAAGGCCAGAAAAACAGCCGCGAAC<br>GCATGAAACGCATTGAAGAAGGCATTAAAGAACTG<br>GGCAGCCAGATTCTGAAAGAACATCCGGTGGAAAA | SEQ ID NO:<br>119 |

-continued

| Description | Sequence | SEQ ID NO: |
|---|---|---|
| | CACCCAGCTGCAGAACGAAAAACTGTATCTGTATTA<br>TCTGCAGAACGGCCGCGATATGTATGTGGATCAGGA<br>ACTGGATATTAACCGCCTGAGCGATTATGATGTGGA<br>TCATATTGTGCCGCAGAGCTTTCTGAAAGATGATAG<br>CATTGATAACAAAGTGCTGACCCGCAGCGATAAAAA<br>CCGCGGCAAAAGCGATAACGTGCCGAGCGAAGAAG<br>TGGTGAAAAAAATGAAAAACTATTGGCGCCAGCTGC<br>TGAACGCGAAACTGATTACCCAGCGCAAATTTGATA<br>ACCTGACCAAAGCGGAACGCGGCGGCCTGAGCGAA<br>CTGGATAAAGCGGGCTTTATTAAACGCCAGCTGGTG<br>GAAACCCGCCAGATTACCAAACATGTGGCGCAGATT<br>CTGGATAGCCGCATGAACACCAAATATGATGAAAAC<br>GATAAACTGATTCGCGAAGTGAAAGTGATTACCCTG<br>AAAAGCAAACTGGTGAGCGATTTTCGCAAAGATTTT<br>CAGTTTTATAAAGTGCGCGAAATTAACAACTATCAT<br>CATGCGCATGATGCGTATCTGAACGCGGTGGTGGGC<br>ACCGCGCTGATTAAAAAATATCCGAAACTGGAAAGC<br>GAATTTGTGTATGGCGATTATAAAGTGTATGATGTG<br>CGCAAAATGATTGCGAAAAGCGAACAGGAAATTGG<br>CAAAGCGACCGCGAAATATTTTTTTTATAGCAACAT<br>TATGAACTTTTTTAAAACCGAAATTACCCTGGCGAA<br>CGGCGAAATTCGCAAACGCCCGCTGATTGAAACCAA<br>CGGCGAAACCGGCGAAATTGTGTGGGATAAAGGCC<br>GCGATTTTGCGACCGTGCGCAAAGTGCTGAGCATGC<br>CGCAGGTGAACATTGTGAAAAAAACCGAAGTGCAG<br>ACCGGCGGCTTTAGCAAAGAAAGCATTCTGCCGAAA<br>CGCAACAGCGATAAACTGATTGCGCGCAAAAAAGA<br>TTGGGATCCGAAAAAATATGGCGGCTTTGATAGCCC<br>GACCGTGGCGTATAGCGTGCTGGTGGTGGCGAAAGT<br>GGAAAAAGGCAAAAGCAAAAAACTGAAAAGCGTGA<br>AAGAACTGCTGGGCATTACCATTATGGAACGCAGCA<br>GCTTTGAAAAAAACCCGATTGATTTTCTGGAAGCGA<br>AAGGCTATAAAGAAGTGAAAAAAGATCTGATTATTA<br>AACTGCCGAAATATAGCCTGTTTGAACTGGAAAACG<br>GCCGCAAACGCATGCTGGCGAGCGCGGGCGAACTG<br>CAGAAAGGCAACGAACTGGCGCTGCCGAGCAAATA<br>TGTGAACTTTCTGTATCTGGCGAGCCATTATGAAAA<br>ACTGAAAGGCAGCCCGGAAGATAACGAACAGAAAC<br>AGCTGTTTGTGGAACAGCATAAACATTATCTGGATG<br>AAATTATTGAACAGATTAGCGAATTTAGCAAACGCG<br>TGATTCTGGCGGATGCGAACCTGGATAAAGTGCTGA<br>GCGCGTATAACAAACATCGCGATAAACCGATTCGCG<br>AACAGGCGGAAAACATTATTCATCTGTTTACCCTGA<br>CCAACCTGGGCGCGCCGGCGGCGTTTAAATATTTTG<br>ATACCACCATTGATCGCAAACGCTATACCAGCACCA<br>AAGAAGTGCTGGATGCGACCCTGATTCATCAGAGCA<br>TTACCGGCCTGTATGAAACCCGCATTGATCTGAGCC<br>AGCTGGGCGGCGAT | |

The base editors described herein may include canonical SpCas9, or any variant thereof having at least 80%, at least 85%, at least 90%, at least 95%, or at least 99% sequence identity with a wild type Cas9 sequence provided above. These variants may include SpCas9 variants containing one or more mutations, including any known mutation reported with the SwissProt Accession No. Q99ZW2 entry, which include:

| SpCas9 mutation (relative to the amino acid sequence of the canonical SpCas9 sequence, SEQ ID NO: 141) | Function/Characteristic (as reported) (see UniProtKB-Q99ZW2 (CAS9_STRPT1) entry-incorporated herein by reference) |
|---|---|
| D10A | Nickase mutant which cleaves the protospacer strand (but no cleavage of non-protospacer strand) |
| S15A | Decreased DNA cleavage activity |
| R66A | Decreased DNA cleavage activity |
| R70A | No DNA cleavage |
| R74A | Decreased DNA cleavage |
| R78A | Decreased DNA cleavage |
| 97-150 deletion | No nuclease activity |
| R165A | Decreased DNA cleavage |
| 175-307 deletion | About 50% decreased DNA cleavage |
| 312-409 deletion | No nuclease activity |
| E762A | Nickase |

-continued

| SpCas9 mutation (relative to the amino acid sequence of the canonical SpCas9 sequence, SEQ ID NO: 141) | Function/Characteristic (as reported) (see UniProtKB-Q99ZW2 (CAS9_STRPT1) entry-incorporated herein by reference) |
|---|---|
| H840A | Nickase mutant which cleaves the non-protospacer strand but does not cleave the protospacer strand |
| N854A | Nickase |
| N863A | Nickase |
| H982A | Decreased DNA cleavage |
| D986A | Nickase |
| 1099-1368 deletion | No nuclease activity |
| R1333A | Reduced DNA binding |

Other wild type SpCas9 sequences that may be used in the present disclosure, include:

| Description | Sequence | SEQ ID NO: |
|---|---|---|
| SpCas9 *Streptococcus pyogenes* MGAS1882 wild type NC_017053.1 | ATGGATAAGAAATACTCAATAGGCTTAGATATCGGCA<br>CAAATAGCGTCGGATGGGCGGTGATCACTGATGATTAT<br>AAGGTTCCGTCTAAAAAGTTCAAGGTTCTGGGAAATAC<br>AGACCGCCACAGTATCAAAAAAAATCTTATAGGGGCT<br>CTTTTATTTGGCAGTGGAGAGACAGCGGAAGCGACTC<br>GTCTCAAACGGACAGCTCGTAGAAGGTATACACGTCG<br>GAAGAATCGTATTTGTTATCTACAGGAGATTTTTTCAA<br>ATGAGATGGCGAAAGTAGATGATAGTTTCTTTCATCGA<br>CTTGAAGAGTCTTTTTTGGTGGAAGAAGACAAGAAGC<br>ATGAACGTCATCCTATTTTTGGAAATATAGTAGATGAA<br>GTTGCTTATCATGAGAAATATCCAACTATCTATCATCT<br>GCGAAAAAAATTGGCAGATTCTACTGATAAAGCGGAT<br>TTGCGCTTAATCTATTTGGCCTTAGCGCATATGATTAA<br>GTTTCGTGGTCATTTTTTGATTGAGGGAGATTTAAATC<br>CTGATAATAGTGATGTGGACAAACTATTTATCCAGTTG<br>GTACAAATCTACAATCAATTATTTGAAGAAAACCCTAT<br>TAACGCAAGTAGAGTAGATGCTAAAGCGATTCTTTCTG<br>CACGATTGAGTAAATCAAGACGATTAGAAAATCTCATT<br>GCTCAGCTCCCCGGTGAGAAGAGAAATGGCTTGTTTGG<br>GAATCTCATTGCTTTGTCATTGGGATTGACCCCTAATTT<br>TAAATCAAATTTTGATTTGGCAGAAGATGCTAAATTAC<br>AGCTTTCAAAAGATACTTACGATGATGATTTAGATAAT<br>TTATTGGCGCAAATTGGAGATCAATATGCTGATTTGTT<br>TTTGGCAGCTAAGAATTTATCAGATGCTATTTTACTTTC<br>AGATATCCTAAGAGTAAATAGTGAAATAACTAAGGCT<br>CCCCTATCAGCTTCAATGATTAAGCGCTACGATGAACA<br>TCATCAAGACTTGACTCTTTTAAAAGCTTTAGTTCGAC<br>AACAACTTCCAGAAAAGTATAAAGAAATCTTTTTTGAT<br>CAATCAAAAAACGGATATGCAGGTTATATTGATGGGG<br>GAGCTAGCCAAGAAGAATTTTATAAATTTATCAAACCA<br>ATTTTAGAAAAAATGGATGGTACTGAGGAATTATTGGT<br>GAAACTAAATCGTGAAGATTTGCTGCGCAAGCAACGG<br>ACCTTTGACAACGGCTCTATTCCCCATCAAATTCACTT<br>GGGTGAGCTGCATGCTATTTTGAGAAGACAAGAAGAC<br>TTTTATCCATTTTTAAAAGACAATCGTGAGAAGATTGA<br>AAAAATCTTGACTTTTCGAATTCCTTATTATGTTGGTCC<br>ATTGGCGCGTGGCAATAGTCGTTTTGCATGGATGACTC<br>GGAAGTCTGAAGAAACAATTACCCCATGGAATTTTGA<br>AGAAGTTGTCGATAAAGGTGCTTCAGCTCAATCATTTA<br>TTGAACGCATGACAAACTTTGATAAAAATCTTCCAAAT<br>GAAAAAGTACTACCAAAACATAGTTTGCTTTATGAGTA<br>TTTTACGGTTTATAACGAATTGACAAAGGTCAAATATG<br>TTACTGAGGGAATGCGAAAACCAGCATTTCTTTCAGGT<br>GAACAGAAGAAAGCCATTGTTGATTTACTCTTCAAAAC<br>AAATCGAAAAGTAACCGTTAAGCAATTAAAAGAAGAT<br>TATTTCAAAAAAATAGAATGTTTTGATAGTGTTGAAAT<br>TTCAGGAGTTGAAGATAGATTTAATGCTTCATTAGGCG<br>CCTACCATGATTTGCTAAAAATTATTAAAGATAAAGAT<br>TTTTTGGATAATGAAGAAAATGAAGATATCTTAGAGG<br>ATATTGTTTTAACATTGACCTTATTTGAAGATAGGGGG<br>ATGATTGAGGAAAGACTTAAAACATATGCTCACCTCTT<br>TGATGATAAGGTGATGAAACAGCTTAAACGTCGCCGTT<br>ATACTGGTTGGGGACGTTTGTCTCGAAAATTGATTAAT<br>GGTATTAGGGATAAGCAATCTGGCAAAACAATATTAG<br>ATTTTTTGAAATCAGATGGTTTTGCCAATCGCAATTTTA<br>TGCAGCTGATCCATGATGATAGTTTGACATTTAAAGAA<br>GATATTCAAAAAGCACAGGTGTCTGGACAAGGCCATA | SEQ ID NO: 120 |

-continued

| Description | Sequence | SEQ ID NO: |
|---|---|---|
| | GTTTACATGAACAGATTGCTAACTTAGCTGGCAGTCCT<br>GCTATTAAAAAAGGTATTTTACAGACTGTAAAAATTGT<br>TGATGAACTGGTCAAAGTAATGGGGCATAAGCCAGAA<br>AATATCGTTATTGAAATGGCACGTGAAAATCAGACAA<br>CTCAAAAGGGCCAGAAAAATTCGCGAGAGCGTATGAA<br>ACGAATCGAAGAAGGTATCAAAGAATTAGGAAGTCAG<br>ATTCTTAAAGAGCATCCTGTTGAAAATACTCAATTGCA<br>AAATGAAAAGCTCTATCTCTATTATCTACAAAATGGAA<br>GAGACATGTATGTGGACCAAGAATTAGATATTAATCGT<br>TTAAGTGATTATGATGTCGATCACATTGTTCCACAAAG<br>TTTCATTAAAGACGATTCAATAGACAATAAGGTACTAA<br>CGCGTTCTGATAAAAATCGTGGTAAATCGGATAACGTT<br>CCAAGTGAAGAAGTAGTCAAAAAGATGAAAAACTATT<br>GGAGACAACTTCTAAACGCCAAGTTAATCACTCAACGT<br>AAGTTTGATAATTTAACGAAAGCTGAACGTGGAGGTTT<br>GAGTGAACTTGATAAAGCTGGTTTTATCAAACGCCAAT<br>TGGTTGAAACTCGCCAAATCACTAAGCATGTGGCACA<br>AATTTTGGATAGTCGCATGAATACTAAATACGATGAAA<br>ATGATAAACTTATTCGAGAGGTTAAAGTGATTACCTTA<br>AAATCTAAATTAGTTTCTGACTTCCGAAAAGATTTCCA<br>ATTCTATAAAGTACGTGAGATTAACAATTACCATCATG<br>CCCATGATGCGTATCTAAATGCCGTCGTTGGAACTGCT<br>TTGATTAAGAAATATCCAAAACTTGAATCGGAGTTTGT<br>CTATGGTGATTATAAAGTTTATGATGTTCGTAAAATGA<br>TTGCTAAGTCTGAGCAAGAAATAGGCAAAGCAACCGC<br>AAAATATTTCTTTTACTCTAATATCATGAACTTCTTCAA<br>AACAGAAATTACACTTGCAAATGGAGAGATTCGCAAA<br>CGCCCTCTAATCGAAACTAATGGGGAAACTGGAGAAA<br>TTGTCTGGGATAAAGGGCGAGATTTTGCCACAGTGCGC<br>AAAGTATTGTCCATGCCCCAAGTCAATATTGTCAAGAA<br>AACAGAAGTACAGACAGGCGGATTCTCCAAGGAGTCA<br>ATTTTACCAAAAAGAAATTCGGACAAGCTTATTGCTCG<br>TAAAAAAGACTGGGATCCAAAAAAATATGGTGGTTTT<br>GATAGTCCAACGGTAGCTTATTCAGTCCTAGTGGTTGC<br>TAAGGTGGAAAAAGGGAAATCGAAGAAGTTAAAATCC<br>GTTAAAGAGTTACTAGGGATCACAATTATGGAAAGAA<br>GTTCCTTTGAAAAAAATCCGATTGACTTTTTAGAAGCT<br>AAAGGATATAAGGAAGTTAAAAAAGACTTAATCATTA<br>AACTACCTAAATATAGTCTTTTTGAGTTAGAAAACGGT<br>CGTAAACGGATGCTGGCTAGTGCCGGAGAATTACAAA<br>AAGGAAATGAGCTGGCTCTGCCAAGCAAATATGTGAA<br>TTTTTTATATTTAGCTAGTCATTATGAAAAGTTGAAGG<br>GTAGTCCAGAAGATAACGAACAAAAACAATTGTTTGT<br>GGAGCAGCATAAGCATTATTTAGATGAGATTATTGAGC<br>AAATCAGTGAATTTTCTAAGCGTGTTATTTTAGCAGAT<br>GCCAATTTAGATAAAGTTCTTAGTGCATATAACAAACA<br>TAGAGACAAACCAATACGTGAACAAGCAGAAAATATT<br>ATTCATTTATTTACGTTGACGAATCTTGGAGCTCCCGCT<br>GCTTTTAAATATTTTGATACAACAATTGATCGTAAACG<br>ATATACGTCTACAAAAGAAGTTTTAGATGCCACTCTTA<br>TCCATCAATCCATCACTGGTCTTTATGAAACACGCATT<br>GATTTGAGTCAGCTAGGAGGTGACTGA | |
| SpCas9<br>*Streptococcus pyogenes*<br>MGAS1882<br>wild type<br>NC_017053.1 | MDKKYSIGLDIGTNSVGWAVITDDYKVPSKKFKVLGNTD<br>RHSIKKNLIGALLFGSGETAEATRLKRTARRRYTRRKNRI<br>CYLQEIFSNEMAKVDDSFFHRLEESFLVEEDKKHERHPIF<br>GNIVDEVAYHEKYPTIYHLRKKLADSTDKADLRLIYLAL<br>AHMIKFRGHFLIEGDLNPDNSDVDKLFIQLVQIYNQLFEE<br>NPINASRVDAKAILSARLSKSRRLENLIAQLPGEKRNGLF<br>GNLIALSLGLTPNFKSNFDLAEDAKLQLSKDTYDDDLDN<br>LLAQIGDQYADLFLAAKNLSDAILLSDILRVNSEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGAYH<br>DLLKIIKDKDFLDNEENEDILEDIVLTLTLFEDRGMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGHSLHEQIANLAGSPAIKKGILQTVKIVDELVKVMGH<br>KPENIVIEMARENQTTQKGQKNSRERMKRIEEGIKELGSQ<br>ILKEHPVENTQLQNEKLYLYYLQNGRDMYVDQELDINRL<br>SDYDVDHIVPQSFIKDDSIDNKVLTRSDKNRGKSDNVPSE<br>EVVKKMKNYWRQLLNAKLITQRKFDNLTKAERGGLSEL<br>DKAGFIKRQLVETRQITKHVAQILDSRMNTKYDENDKLI | SEQ ID NO: 121 |

-continued

| Description | Sequence | SEQ ID NO: |
|---|---|---|
| | REVKVITLKSKLVSDFRKDFQFYKVREINNYHHAHDAYL<br>NAVVGTALIKKYPKLESEFVYGDYKVYDVRKMIAKSEQ<br>EIGKATAKYFFYSNIMNFFKTEITLANGEIRKRPLIETNGE<br>TGEIVWDKGRDFATVRKVLSMPQVNIVKKTEVQTGGFS<br>KESILPKRNSDKLIARKKDWDPKKYGGFDSPTVAYSVLV<br>VAKVEKGKSKKLKSVKELLGITIMERSSFEKNPIDFLEAK<br>GYKEVKKDLIIKLPKYSLFELENGRKRMLASAGELQKGN<br>ELALPSKYVNFLYLASHYEKLKGSPEDNEQKQLFVEQHK<br>HYLDEIIEQISEFSKRVILADANLDKVLSAYNKHRDKPIRE<br>QAENIIHLFTLTNLGAPAAFKYFDTTIDRKRYTSTKEVLD<br>ATLIHQSITGLYETRIDLSQLGGD | |
| SpCas9<br>*Streptococcus pyogenes*<br>wild type<br>SWBC2D7W014 | ATGGATAAAAAGTATTCTATTGGTTTAGACATCGGCAC<br>TAATTCCGTTGGATGGGCTGTCATAACCGATGAATACA<br>AAGTACCTTCAAAGAAATTTAAGGTGTTGGGGAACAC<br>AGACCGTCATTCGATTAAAAAGAATCTTATCGGTGCCC<br>TCCTATTCGATAGTGGCGAAACGGCAGAGGCGACTCG<br>CCTGAAACGAACCGCTCGGAGAAGGTATACACGTCGC<br>AAGAACCGAATATGTTACTTACAAGAAATTTTTAGCAA<br>TGAGATGGCCAAAGTTGACGATTCTTTCTTTCACCGTT<br>TGGAAGAGTCCTTCCTTGTCGAAGAGGACAAGAAACA<br>TGAACGGCACCCCATCTTTGGAAACATAGTAGATGAG<br>GTGGCATATCATGAAAAGTACCCAACGATTTATCACCT<br>CAGAAAAAAGCTAGTTGACTCAACTGATAAAGCGGAC<br>CTGAGGTTAATCTACTTGGCTCTTGCCCATATGATAAA<br>GTTCCGTGGGCACTTTCTCATTGAGGGTGATCTAAATC<br>CGGACAACTCGGATGTCGACAAACTGTTCATCCAGTTA<br>GTACAAACCTATAATCAGTTGTTTGAAGAGAACCCTAT<br>AAATGCAAGTGGCGTGGATGCGAAGGCTATTCTTAGC<br>GCCCGCCTCTCTAAATCCCGACGGCTAGAAAACCTGAT<br>CGCACAATTACCCGGAGAGAAGAAAAATGGGTTGTTC<br>GGTAACCTTATAGCGCTCTCACTAGGCCTGACACCAAA<br>TTTTAAGTCGAACTTCGACTTAGCTGAAGATGCCAAAT<br>TGCAGCTTAGTAAGGACACGTACGATGACGATCTCGA<br>CAATCTACTGGCACAAATTGGAGATCAGTATGCGGACT<br>TATTTTTGGCTGCCAAAAACCTTAGCGATGCAATCCTC<br>CTATCTGACATACTGAGAGTTAATACTGAGATTACCAA<br>GGCGCCGTTATCCGCTTCAATGATCAAAAGGTACGATG<br>AACATCACCAAGACTTGACACTTCTCAAGGCCCTAGTC<br>CGTCAGCAACTGCCTGAGAAATATAAGGAAATATTCTT<br>TGATCAGTCGAAAAACGGGTACGCAGGTTATATTGAC<br>GGCGGAGCGAGTCAAGAGGAATTCTACAAGTTTATCA<br>AACCCATATTAGAGAAGATGGATGGGACGGAAGAGTT<br>GCTTGTAAAACTCAATCGCGAAGATCTACTGCGAAAG<br>CAGCGGACTTTCGACAACGGTAGCATTCCACATCAAAT<br>CCACTTAGGCGAATTGCATGCTATACTTAGAAGGCAGG<br>AGGATTTTTATCCGTTCCTCAAAGACAATCGTGAAAAG<br>ATTGAGAAAATCCTAACCTTTCGCATACCTTACTATGT<br>GGGACCCCTGGCCCGAGGGAACTCTCGGTTCGCATGG<br>ATGACAAGAAAGTCCGAAGAAACGATTACTCCATGGA<br>ATTTTGAGGAAGTTGTCGATAAAGGTGCGTCAGCTCAA<br>TCGTTCATCGAGAGGATGACCAACTTTGACAAGAATTT<br>ACCGAACGAAAAAGTATTGCCTAAGCACAGTTTACTTT<br>ACGAGTATTTCACAGTGTACAATGAACTCACGAAAGTT<br>AAGTATGTCACTGAGGGCATGCGTAAACCCGCCTTTCT<br>AAGCGGAGAACAGAAGAAAGCAATAGTAGATCTGTTA<br>TTCAAGACCAACCGCAAAGTGACAGTTAAGCAATTGA<br>AAGAGGACTACTTTAAGAAAATTGAATGCTTCGATTCT<br>GTCGAGATCTCCGGGGTAGAAGATCGATTTAATGCGTC<br>ACTTGGTACGTATCATGACCTCCTAAAGATAATTAAAG<br>ATAAGGACTTCCTGGATAACGAAGAGAATGAAGATAT<br>CTTAGAAGATATAGTGTTGACTCTTACCCTCTTTGAAG<br>ATCGGGAAATGATTGAGGAAAGACTAAAAACATACGC<br>TCACCTGTTCGACGATAAGGTTATGAAACAGTTAAAGA<br>GGCGTCGCTATACGGGCTGGGGACGATTGTCGCGGAA<br>ACTTATCAACGGGATAAGAGACAAGCAAAGTGGTAAA<br>ACTATTCTCGATTTTCTAAAGAGCGACGGCTTCGCCAA<br>TAGGAACTTTATGCAGCTGATCCATGATGACTCTTTAA<br>CCTTCAAAGAGGATATACAAAAGGCACAGGTTTCCGG<br>ACAAGGGGACTCATTGCACGAACATATTGCGAATCTTG<br>CTGGTTCGCCAGCCATCAAAAAGGGCATACTCCAGAC<br>AGTCAAAGTAGTGGATGAGCTAGTTAAGGTCATGGGA<br>CGTCACAAACCGGAAAACATTGTAATCGAGATGGCAC<br>GCGAAAATCAAACGACTCAGAAGGGGCAAAAAAACA<br>GTCGAGAGCGGATGAAGAGAATAGAAGAGGGTATTAA<br>AGAACTGGGCAGCCAGATCTTAAAGGAGCATCCTGTG<br>GAAAATACCCAATTGCAGAACGAGAAACTTTACCTCT | SEQ ID NO: 122 |

-continued

| Description | Sequence | SEQ ID NO: |
|---|---|---|
| | ATTACCTACAAAATGGAAGGGACATGTATGTTGATCA GGAACTGGACATAAACCGTTTATCTGATTACGACGTCG ATCACATTGTACCCCAATCCTTTTTGAAGGACGATTCA ATCGACAATAAAGTGCTTACACGCTCGGATAAGAACC GAGGGAAAAGTGACAATGTTCCAAGCGAGGAAGTCGT AAAGAAAATGAAGAACTATTGGCGGCAGCTCCTAAAT GCGAAACTGATAACGCAAAGAAAGTTCGATAACTTAA CTAAAGCTGAGAGGGGTGGCTTGTCTGAACTTGACAA GGCCGGATTTATTAAACGTCAGCTCGTGGAAACCCGCC AAATCACAAAGCATGTTGCACAGATACTAGATTCCCG AATGAATACGAAATACGACGAGAACGATAAGCTGATT CGGGAAGTCAAAGTAATCACTTTAAAGTCAAAATTGG TGTCGGACTTCAGAAAGGATTTTCAATTCTATAAAGTT AGGGAGATAAATAACTACCACCATGCGCACGACGCTT ATCTTAATGCCGTCGTAGGGACCGCACTCATTAAGAAA TACCCGAAGCTAGAAAGTGAGTTTGTGTATGGTGATTA CAAAGTTTATGACGTCCGTAAGATGATCGCGAAAAGC GAACAGGAGATAGGCAAGGCTACAGCCAAATACTTCT TTTATTCTAACATTATGAATTTCTTTAAGACGGAAATC ACTCTGGCAAACGGAGAGATACGCAAACGACCTTTAA TTGAAACCAATGGGGAGACAGGTGAAATCGTATGGGA TAAGGGCCGGGACTTCGCGACGGTGAGAAAAGTTTTG TCCATGCCCCAAGTCAACATAGTAAAGAAAACTGAGG TGCAGACCGGAGGGTTTTCAAAGGAATCGATTCTTCCA AAAAGGAATAGTGATAAGCTCATCGCTCGTAAAAAGG ACTGGGACCCGAAAAAGTACGGTGGCTTCGATAGCCC TACAGTTGCCTATTCTGTCCTAGTAGTGGCAAAAGTTG AGAAGGGAAAATCCAAGAAACTGAAGTCAGTCAAAGA ATTATTGGGGATAACGATTATGGAGCGCTCGTCTTTTG AAAAGAACCCCATCGACTTCCTTGAGGCGAAAGGTTA CAAGGAAGTAAAAAAGGATCTCATAATTAAACTACCA AAGTATAGTCTGTTTGAGTTAGAAAATGGCCGAAAAC GGATGTTGGCTAGCGCCGGAGAGCTTCAAAAGGGGAA CGAACTCGCACTACCGTCTAAATACGTGAATTTCCTGT ATTTAGCGTCCCATTACGAGAAGTTGAAAGGTTCACCT GAAGATAACGAACAGAAGCAACTTTTTGTTGAGCAGC ACAAACATTATCTCGACGAAATCATAGAGCAAATTTCG GAATTCAGTAAGAGAGTCATCCTAGCTGATGCCAATCT GGACAAAGTATTAAGCGCATACAACAAGCACAGGGAT AAACCCATACGTGAGCAGGCGGAAAATATTATCCATTT GTTTACTCTTACCAACCTCGGCGCTCCAGCCGCATTCA AGTATTTTGACACAACGATAGATCGCAAACGATACACT TCTACCAAGGAGGTGCTAGACGCGACACTGATTCACC AATCCATCACGGGATTATATGAAACTCGGATAGATTTG TCACAGCTTGGGGGTGACGGATCCCCCAAGAAGAAGA GGAAAGTCTCGAGCGACTACAAAGACCATGACGGTGA TTATAAAGATCATGACATCGATTACAAGGATGACGAT GACAAGGCTGCAGGA | |
| SpCas9 *Streptococcus pyogenes* wild type Encoded product of SWBC2D7W014 | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRED LLRKQRTFDNGSIPHQIHLGELHAILRRQEDFYPFLKDNR EKIEKILTFRIPYYVGPLARGNSRFAWMTRKSEETITPWNF EEVVDKGASAQSFIERMTNFDKNLPNEKVLPKHSLLYEY FTVYNELTKVKYVTEGMRKPAFLSGEQKKAIVDLLFKTN RKVTVKQLKEDYFKKIECFDSVETSGVEDRFNASLGTYH DLLKIIKDKDFLDNEENEDILEDIVLTLTLFEDREMIEERL KTYAHLFDDKVMKQLKRRRYTGWGRLSRKLINGIRDKQ SGKTILDFLKSDGFANRNFMQLIHDDSLTFKEDIQKAQVS GQGDSLHEHIANLAGSPAIKKGILQTVKVVDELVKVMGR HKPENIVIEMARENQTTQKGQKNSRERMKRIEEGIKELGS QILKEHPVENTQLQNEKLYLYYLQNGRDMYVDQELDIN RLSDYDVDHIVPQSFLKDDSIDNKVLTRSDKNRGKSDNV PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG | SEQ ID NO: 123 |

-continued

| Description | Sequence | SEQ ID NO: |
|---|---|---|
| | GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGDGSPKKKRKVSSDY<br>KDHDGDYKDHDIDYKDDDDKAAG | |
| SpCas9<br>*Streptococcus pyogenes*<br>M1GAS wild type<br>NC_002737.2 | ATGGATAAGAAATACTCAATAGGCTTAGATATCGGCA<br>CAAATAGCGTCGGATGGGCGGTGATCACTGATGAATA<br>TAAGGTTCCGTCTAAAAAGTTCAAGGTTCTGGGAAATA<br>CAGACCGCCACAGTATCAAAAAAAATCTTATAGGGGC<br>TCTTTTATTTGACAGTGGAGAGACAGCGGAAGCGACTC<br>GTCTCAAACGGACAGCTCGTAGAAGGTATACACGTCG<br>GAAGAATCGTATTTGTTATCTACAGGAGATTTTTTCAA<br>ATGAGATGGCGAAAGTAGATGATAGTTTCTTTCATCGA<br>CTTGAAGAGTCTTTTTTGGTGGAAGAAGACAAGAAGC<br>ATGAACGTCATCCTATTTTTGGAAATATAGTAGATGAA<br>GTTGCTTATCATGAGAAATATCCAACTATCTATCATCT<br>GCGAAAAAAATTGGTAGATTCTACTGATAAAGCGGAT<br>TTGCGCTTAATCTATTTGGCCTTAGCGCATATGATTAA<br>GTTTCGTGGTCATTTTTTGATTGAGGGAGATTTAAATC<br>CTGATAATAGTGATGTGGACAAACTATTTATCCAGTTG<br>GTACAAACCTACAATCAATTATTTGAAGAAAACCCTAT<br>TAACGCAAGTGGAGTAGATGCTAAAGCGATTCTTTCTG<br>CACGATTGAGTAAATCAAGACGATTAGAAAATCTCATT<br>GCTCAGCTCCCCGGTGAGAAGAAAAATGGCTTATTTGG<br>GAATCTCATTGCTTTGTCATTGGGTTTGACCCCTAATTT<br>TAAATCAAATTTTGATTTGGCAGAAGATGCTAAATTAC<br>AGCTTTCAAAAGATACTTACGATGATGATTTAGATAAT<br>TTATTGGCGCAAATTGGAGATCAATATGCTGATTTGTT<br>TTTGGCAGCTAAGAATTTATCAGATGCTATTTTACTTTC<br>AGATATCCTAAGAGTAAATACTGAAATAACTAAGGCT<br>CCCCTATCAGCTTCAATGATTAAACGCTACGATGAACA<br>TCATCAAGACTTGACTCTTTTAAAAGCTTTAGTTCGAC<br>AACAACTTCCAGAAAAGTATAAAGAAATCTTTTTTGAT<br>CAATCAAAAAACGGATATGCAGGTTATATTGATGGGG<br>GAGCTAGCCAAGAAGAATTTTATAAATTTATCAAACCA<br>ATTTTAGAAAAAATGGATGGTACTGAGGAATTATTGGT<br>GAAACTAAATCGTGAAGATTTGCTGCGCAAGCAACGG<br>ACCTTTGACAACGGCTCTATTCCCCATCAAATTCACTT<br>GGGTGAGCTGCATGCTATTTTGAGAAGACAAGAAGAC<br>TTTTATCCATTTTTAAAAGACAATCGTGAGAAGATTGA<br>AAAAATCTTGACTTTTCGAATTCCTTATTATGTTGGTCC<br>ATTGGCGCGTGGCAATAGTCGTTTTGCATGGATGACTC<br>GGAAGTCTGAAGAAACAATTACCCCATGGAATTTTGA<br>AGAAGTTGTCGATAAAGGTGCTTCAGCTCAATCATTTA<br>TTGAACGCATGACAAACTTTGATAAAAATCTTCCAAAT<br>GAAAAAGTACTACCAAAACATAGTTTGCTTTATGAGTA<br>TTTTACGGTTTATAACGAATTGACAAAGGTCAAATATG<br>TTACTGAAGGAATGCGAAAACCAGCATTTCTTTCAGGT<br>GAACAGAAGAAAGCCATTGTTGATTTACTCTTCAAAAC<br>AAATCGAAAAGTAACCGTTAAGCAATTAAAAGAAGAT<br>TATTTCAAAAAAATAGAATGTTTTGATAGTGTTGAAAT<br>TTCAGGAGTTGAAGATAGATTTAATGCTTCATTAGGTA<br>CCTACCATGATTTGCTAAAAATTATTAAAGATAAAGAT<br>TTTTTGGATAATGAAGAAAATGAAGATATCTTAGAGG<br>ATATTGTTTTAACATTGACCTTATTTGAAGATAGGGAG<br>ATGATTGAGGAAAGACTTAAAACATATGCTCACCTCTT<br>TGATGATAAGGTGATGAAACAGCTTAAACGTCGCCGTT<br>ATACTGGTTGGGGACGTTTGTCTCGAAAATTGATTAAT<br>GGTATTAGGGATAAGCAATCTGGCAAAACAATATTAG<br>ATTTTTTGAAATCAGATGGTTTTGCCAATCGCAATTTTA<br>TGCAGCTGATCCATGATGATAGTTTGACATTTAAAGAA<br>GACATTCAAAAAGCACAAGTGTCTGGACAAGGCGATA<br>GTTTACATGAACATATTGCAAATTTAGCTGGTAGCCCT<br>GCTATTAAAAAAGGTATTTTACAGACTGTAAAAGTTGT<br>TGATGAATTGGTCAAAGTAATGGGGCGGCATAAGCCA<br>GAAAATATCGTTATTGAAATGGCACGTGAAAATCAGA<br>CAACTCAAAAGGGCCAGAAAAATTCGCGAGAGCGTAT<br>GAAACGAATCGAAGAAGGTATCAAAGAATTAGGAAGT<br>CAGATTCTTAAAGAGCATCCTGTTGAAAATACTCAATT<br>GCAAAATGAAAAGCTCTATCTCTATTATCTCCAAAATG<br>GAAGAGACATGTATGTGGACCAAGAATTAGATATTAA<br>TCGTTTAAGTGATTATGATGTCGATCACATTGTTCCAC<br>AAAGTTTCCTTAAAGACGATTCAATAGACAATAAGGTC | SEQ ID NO: 124 |

-continued

| Description | Sequence | SEQ ID NO: |
|---|---|---|
| | TTAACGCGTTCTGATAAAAATCGTGGTAAATCGGATAA<br>CGTTCCAAGTGAAGAAGTAGTCAAAAAGATGAAAAAC<br>TATTGGAGACAACTTCTAAACGCCAAGTTAATCACTCA<br>ACGTAAGTTTGATAATTTAACGAAAGCTGAACGTGGA<br>GGTTTGAGTGAACTTGATAAAGCTGGTTTTATCAAACG<br>CCAATTGGTTGAAACTCGCCAAATCACTAAGCATGTGG<br>CACAAATTTTGGATAGTCGCATGAATACTAAATACGAT<br>GAAAATGATAAACTTATTCGAGAGGTTAAAGTGATTA<br>CCTTAAAATCTAAATTAGTTTCTGACTTCCGAAAAGAT<br>TTCCAATTCTATAAAGTACGTGAGATTAACAATTACCA<br>TCATGCCCATGATGCGTATCTAAATGCCGTCGTTGGAA<br>CTGCTTTGATTAAGAAATATCCAAAACTTGAATCGGAG<br>TTTGTCTATGGTGATTATAAAGTTTATGATGTTCGTAA<br>AATGATTGCTAAGTCTGAGCAAGAAATAGGCAAAGCA<br>ACCGCAAAATATTTCTTTTACTCTAATATCATGAACTTC<br>TTCAAAACAGAAATTACACTTGCAAATGGAGAGATTC<br>GCAAACGCCCTCTAATCGAAACTAATGGGGAAACTGG<br>AGAAATTGTCTGGGATAAAGGGCGAGATTTTGCCACA<br>GTGCGCAAAGTATTGTCCATGCCCCAAGTCAATATTGT<br>CAAGAAAACAGAAGTACAGACAGGCGGATTCTCCAAG<br>GAGTCAATTTTACCAAAAAGAAATTCGGACAAGCTTAT<br>TGCTCGTAAAAAAGACTGGGATCCAAAAAAATATGGT<br>GGTTTTGATAGTCCAACGGTAGCTTATTCAGTCCTAGT<br>GGTTGCTAAGGTGGAAAAAGGGAAATCGAAGAAGTTA<br>AAATCCGTTAAAGAGTTACTAGGGATCACAATTATGG<br>AAAGAAGTTCCTTTGAAAAAAATCCGATTGACTTTTTA<br>GAAGCTAAAGGATATAAGGAAGTTAAAAAAGACTTAA<br>TCATTAAACTACCTAAATATAGTCTTTTTGAGTTAGAA<br>AACGGTCGTAAACGGATGCTGGCTAGTGCCGGAGAAT<br>TACAAAAAGGAAATGAGCTGGCTCTGCCAAGCAAATA<br>TGTGAATTTTTTATATTTAGCTAGTCATTATGAAAAGTT<br>GAAGGGTAGTCCAGAAGATAACGAACAAAAACAATTG<br>TTTGTGGAGCAGCATAAGCATTATTTAGATGAGATTAT<br>TGAGCAAATCAGTGAATTTTCTAAGCGTGTTATTTTAG<br>CAGATGCCAATTTAGATAAAGTTCTTAGTGCATATAAC<br>AAACATAGAGACAAACCAATACGTGAACAAGCAGAAA<br>ATATTATTCATTTATTTACGTTGACGAATCTTGGAGCTC<br>CCGCTGCTTTTAAATATTTTGATACAACAATTGATCGT<br>AAACGATATACGTCTACAAAAGAAGTTTTAGATGCCA<br>CTCTTATCCATCAATCCATCACTGGTCTTTATGAAACA<br>CGCATTGATTTGAGTCAGCTAGGAGGTGACTGA | |
| SpCas9 *Streptococcus pyogenes* M1GAS wild type Encoded product of NC_002737.2 (100% identical to the canonical Q99ZW2 wild type) | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS | SEQ ID NO: 125 |

-continued

| Description | Sequence | SEQ ID NO: |
|---|---|---|
| | VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | |

The base editors described herein may include any of the above SpCas9 sequences, or any variant thereof having at least 80%, at least 85%, at least 90%, at least 95%, or at least 99% sequence identity thereto.

Wild Type Cas9 Orthologs

In other embodiments, the Cas9 protein can be a wild type Cas9 ortholog from another bacterial species. For example, the following Cas9 orthologs can be used in connection with the base editor constructs described in this disclosure. In addition, any variant Cas9 orthologs having at least 80%, at least 85%, at least 90%, at least 95%, or at least 99% sequence identity to any of the below orthologs may also be used with the disclosed base editors.

| Description | Sequence |
|---|---|
| LfCas9<br>*Lactobacillus fermentum* wild type<br>GenBank: SNX31424.11 | MKEYHIGLDIGTSSIGWAVTDSQFKLMRIKGKTAIGVRLFEEGKTAAERR<br>TFRTTRRRLKRRKWRLHYLDEIFAPHLQEVDENFLRRLKQSNIHPEDPTK<br>NQAFIGKLLFPDLLKKNERGYPTLIKMRDELPVEQRAHYPVMNIYKLREA<br>MINEDRQFDLREVYLAVHHIVKYRGHFLNNASVDKFKVGRIDFDKSFNV<br>LNEAYEELQNGEGSFTIEPSKVEKIGQLLLDTKMRKLDRQKAVAKLLEV<br>KVADKEETKRNKQIATAMSKLVLGYKADFATVAMANGNEWKIDLSSET<br>SEDEIEKFREELSDAQNDILTEITSLFSQIMLNEIVPNGMSISESMMDRYWT<br>HERQLAEVKEYLATQPASARKEFDQVYNKYIGQAPKERGFDLEKGLKKI<br>LSKKENWKEIDELLKAGDFLPKQRTSANGVIPHQMHQQELDRIIEKQAKY<br>YPWLATENPATGERDRHQAKYELDQLVSFRIPYYVGPLVTPEVQKATSG<br>AKFAWAKRKEDGEITPWNLWDKIDRAESAEAFIKRMTVKDTYLLNEDV<br>LPANSLLYQKYNVLNELNNVRVNGRRLSVGIKQDIYTELFKKKKTVKAS<br>DVASLVMAKTRGVNKPSVEGLSDPKKFNSNLATYLDLKSIVGDKVDDN<br>RYQTDLENIIEWRSVFEDGEIFADKLTEVEWLTDEQRSALVKKRYKGWG<br>RLSKKLLTGIVDENGQRIIDLMWNTDQNFKEIVDQPVFKEQIDQLNQKAI<br>TNDGMTLRERVESVLDDAYTSPQNKKAIWQVVRVVEDIVKAVGNAPKSI<br>SIEFARNEGNKGEITRSRRTQLQKLFEDQAHELVKDTSLTEELEKAPDLSD<br>RYYFYFTQGGKDMYTGDPINFDEISTKYDIDHILPQSFVKDNSLDNRVLTS<br>RKENNKKSDQVPAKLYAAKMKPYWNQLLKQGLITQRKFENLTKDVDQ<br>NIKYRSLGFVKRQLVETRQVIKLTANILGSMYQEAGTEIIETRAGLTKQLR<br>EEFDLPKVREVNDYHHAVDAYLTTFAGQYLNRRYPKLRSFFVYGEYMK<br>FKHGSDLKLRNFNFFHELMEGDKSQGKVVDQQTGELITTRDEVAKSFDR<br>LLNMKYMLVSKEVHDRSDQLYGATIVTAKESGKLTSPIEIKKNRLVDLY<br>GAYTNGTSAFMTIIKFTGNKPKYKVIGIPTTSAASLKRAGKPGSESYNQEL<br>HRIIKSNPKVKKGFEIVVPHVSYGQLIVDGDCKFTLASPTVQHPATQLVLS<br>KKSLETISSGYKILKDKPAIANERLIRVFDEVVGQMNRYFTIFDQRSNRQK<br>VADARDKFLSLPTESKYEGAKKVQVGKTEVITNLLMGLHANATQGDLK<br>VLGLATFGFFQSTTGLSLSEDTMIVYQSPTGLFERRICLKDI<br>(SEQ ID NO: 126) |
| SaCas9<br>*Staphylococcus aureus* wild type<br>GenBank: AYD60528.1 | MDKKYSIGLDIGTNSVGWAVITDEYKVPSKKFKVLGNTDRHSIKKNLIGA<br>LLFDSGETAEATRLKRTARRRYTRRKNRICYLQEIFSNEMAKVDDSFFHR<br>LEESFLVEEDKKHERHPIFGNIVDEVAYHEKYPTIYHLRKKLVDSTDKAD<br>LRLIYLALAHMIKFRGHFLIEGDLNPDNSDVDKLFIQLVQTYNQLFEENPI<br>NASGVDAKAILSARLSKSRRLENLIAQLPGEKKNGLFGNLIALSLGLTPNF<br>KSNFDLAEDAKLQLSKDTYDDDLDNLLAIGDQYADLFLAAKNLSDAILL<br>SDILRVNTEITKAPLSASMIKRYDEHHQDLTLLKALVRQQLPEKYKEIFFD<br>QSKNGYAGYIDGGASQEEFYKFIKPILEKMDGTEELLVKLNREDLLRKQR<br>TFDNGSIPHQIHLGELHAILRRQEDFYPFLKDNREKIEKILTFRIPYYVGPL<br>ARGNSRFAWMTRKSEETITPWNFEEVVDKGASAQSFIERMTNFDKNLPN<br>EKVLPKHSLLYEYFTVYNELTKVKYVEGMRKPAFLSGEQKKAIVDLLFK<br>TNRKVTVKQLKEDYFKKIECFDSVEISGVEDRFNASLGTYHDLLKIIKDK<br>DFLDNEENEDILEDIVLTLTLFEDREMIEERLKTYAHLFDDKVMKQLKRR<br>RYTGWGRLSRKLINGIRDKQSGKTILFLKSDGFANRNFMQLIHDDSLTFK<br>EDIQKAQVSGQGDSLHEHIANLAGSPAIKKGILQTVKVVDELVKVMGRH<br>KPENIVIEMARENQTTQKGQKNSRERMKRIEEGIKELGSQILKEHPVENTQ<br>LQNEKLYLYYLQNGRMYVDQELDINRLSDYDVDHIVPQSFLKDDSIDNK<br>VLTRSDKNRGKSDNVPSEEVVKKMKNYWRQLLNAKLITQRKFDNLTKA<br>ERGGLSELDKAGFIKRQLVETRQITKHVAQILDSRMNTKYDENDKLIREV<br>KVITLKSKLVSDFRKDFQFYKVREINNYHHAHDAYLNAVVGTALIKKPK<br>LESEFVYGDYKVYDVRKMIAKSEQEIGKATAKYFFYSNIMNFFKTEITLA<br>NGEIRKRPLIETNGETGEIVWDKGRDFATVRKVLSMPQVNIVKKTEVQTG<br>GFSKESILPKRNSDKLIARKKDWDPKKYGGFDSPTVAYSVLVVAKVEKG<br>KSKKLKSVKELLGITIMERSSFEKNPIDFLEAKGYKEVKKDLIIKLPKYSLF<br>ELENGRKRMLASAGELQKGNELALPSKYVNFLYLASYEKLKGSPEDNEQ<br>KQLFVEQHKHYLDEIIEQISEFSKRVILADANLDKVLSAYNKHRDKPIREQ |

-continued

| Description | Sequence |
|---|---|
| | AENIIHLFTLTNLGAPAAFKYFDTTIDRKRYTSTKEVLDATLIHQSITGLYE<br>TRIDLSQLGGD (SEQ ID NO: 127) |
| SaCas9<br>*Staphylococcus*<br>*aureus* | MGKRNYILGLDIGITSVGYGIIDYETRDVIDAGVRLFKEANVENNEGRRS<br>KRGARRLKRRRRHRIQRVKKLLFDYNLLTDHSELSGINPYEARVKGLSQ<br>KLSEEEFSAALLHLAKRRGVHNVNEVEEDTGNELSTKEQISRNSKALEEK<br>YVAELQLERLKKDGEVRGSINRFKTSDYVKEAKQLLKVQKAYHQLDQSF<br>IDTYIDLLETRRTYYEGPGEGSPFGWKDIKEWYEMLMGHCTYFPEELRSV<br>KYAYNADLYNALNDLNNLVITRDENEKLEYYEKFQIIENVFKQKKKPTL<br>KQIAKEILVNEEDIKGYRVTSTGKPEFTNLKVYHDIKDITARKEIIENAELL<br>DQIAKILTIYQSSEDIQEELTNLNSELTQEEIEQISNLKGYTGTHNLSLKAIN<br>LILDELWHTNDNQIAIFNRLKLVPKKVDLSQQKEIPTTLVDDFILSPVVKR<br>SFIQSIKVINAIIKKYGLPNDIIIELAREKNSKDAQKMINEMQKRNRQTNER<br>IEEIIRTTGKENAKYLIEKIKLHDMQEGKCLYSLEAIPLEDLLNNPFNYEVD<br>HIIPRSVSFDNSFNNKVLVKQEENSKKGNRTPFQYLSSSDSKISYETFKKHI<br>LNLAKGKGRISKTKKEYLLEERDINRFSVQKDFINRNLVDTRYATRGLMN<br>LLRSYFRVNNLDVKVKSINGGFTSFLRRKWKFKKERNKGYKHHAEDALI<br>IANADFIFKEWKKLDKAKKVMENQMFEEKQAESMPEIETEQEYKEIFITP<br>HQIKHIKDFKDYKYSHRVDKKPNRKLINDTLYSTRKDDKGNTLIVNNLN<br>GLYDKDNDKLKKLINKSPEKLLMYHHDPQTYQKLKLIMEQYGDEKNPL<br>YKYYEETGNYLTKYSKKDNGPVIKKIKYYGNKLNAHLDITDDYPNSRNK<br>VVKLSLKPYRFDVYLDNGVYKFVTVKNLDVIKKENYYEVNSKCYEEAK<br>KLKKISNQAEFIASFYKNDLIKINGELYRVIGVNNDLLNRIEVNMIDITYRE<br>YLENMNDKRPPHIIKTIASKTQSIKKYSTDILGNLYEVKSKKHPQIIKK<br>(SEQ ID NO: 128) |
| StCas9<br>*Streptococcus*<br>*thermophilus*<br>UniProtKB/<br>Swiss-Prot:<br>G3ECR1.2<br>Wild type | MLFNKCIIISINLDFSNKEKCMTKPYSIGLDIGTNSVGWAVITDNYKVPSK<br>KMKVLGNTSKKYIKKNLLGVLLFDSGITAEGRRLKRTARRRYTRRRNRIL<br>YLQEIFSTEMATLDDAFFQRLDDSFLVPDDKRDSKYPIFGNLVEEKVYHD<br>EFPTIYHLRKYLADSTKKADLRLVYLALAHMIKYRGHFLIEGEFNSKNND<br>IQKNFQDFLDTYNAIFESDLSLENSKQLEEIVKDKISKLEKKDRILKLFPGE<br>KNSGIFSEFLKLIVGNQADFRKCFNLDEKASLHFSKESYDEDLETLLGYIG<br>DDYSDVFLKAKKLYDAILLSGFLTVTDNETEAPLSSAMIKRYNEHKEDLA<br>LLKEYIRNISLKTYNEVFKDDTKNGYAGYIDGKTNQEDFYVYLKNLLAEF<br>EGADYFLEKIDREDFLRKQRTFDNGSIPYQIHLQEMRAILDKQAKFYPFLA<br>KNKERIEKILTFRIPYYVGPLARGNSDFAWSIRKRNEKITPWNFEDVIDKE<br>SSAEAFINRMTSFDLYLPEEKVLPKHSLLYETFNVYNELTKVRFIAESMRD<br>YQFLDSKQKKDIVRLYFKDKRKVTDKDIIEYLHAIYGYDGIELKGIEKQF<br>NSSLSTYHDLLNIINDKEFLDDSSNEAIIEEIIHTLTIFEDREMIKQRLSKFEN<br>IFDKSVLKKLSRRHYTGWGKLSAKLINGIRDEKSGNTILDYLIDDGISNRN<br>FMQLIHDDALSFKKKIQKAQIIGDEDKGNIKEVVKSLPGSPAIKKGILQSIK<br>IVDELVKVMGGRKPESIVVEMARENQYTNQGKSNSQQRLKRLEKSLKEL<br>GSKILKENIPAKLSKIDNNALQNDRLYLYYLQNGKDMYTGDDLDIDRLS<br>NYDIDHIIPQAFLKDNSIDNKVLVSSASNRGKSDDFPSLEVVKKRKTFWY<br>QLLKSKLISQRKFDNLTKAERGGLLPEDKAGFIQRQLVETRQITKHVARL<br>LDEKFNNKKDENNRAVRTVKIITLKSTLVSQFRKDFELYKVREINDFHHA<br>HDAYLNAVIASALLKKYPKLEPEFVYGDYPKYNSFRERKSATEKVYFYS<br>NIMNIFKKSISLADGRVIERPLIEVNEETGESVWNKESDLATVRRVLSYPQ<br>VNVVKKVEEQNHGLDRGKPKGLFNANLSSKPKPNSNENLVGAKEYLDP<br>KKYGGYAGISNSFAVLVKGTIEKGAKKKITNVLEFQGISILDRINYRKDKL<br>NFLLEKGYKDIELIIELPKYSLFELSDGSRRMLASILSTNNKRGEIHKGNQI<br>FLSQKFVKLLYHAKRISNTINENHRKYVENHKKEFEELFYYILEFNENYV<br>GAKKNGKLLNSAFQSWQNHSIDELCSSFIGPTGSERKGLFELTSRGSAAD<br>FEFLGVKIPRYRDYTPSSLLKDATLIHQSVTGLYETRIDLAKLGEG<br>(SEQ ID NO: 129) |
| LcCas9<br>*Lactobacillus*<br>*crispatus*<br>NCBI<br>Reference<br>Sequence:<br>WP_<br>133478044.1<br>Wild type | MKIKNYNLALTPSTSAVGHVEVDDDLNILEPVHHQKAIGVAKFGEGETA<br>EARRLARSARRTTKRRANRINHYFNEIMKPEIDKVDPLMFDRIKQAGLSP<br>LDERKEFRTVIFDRPNIASYYHNQFPTIWHLQKYLMITDEKADIRLIYWAL<br>HSLLKHRGHFFNTTPMSQFKPGKLNLKDDMLALDDYNDLEGLSFAVANS<br>PEIEKVIKDRSMHKKEKIAELKKLIVNDVPDKDLAKRNNKIITQIVNAIMG<br>NSFHLNFIFDMDLDKLTSKAWSFKLDDPELDTKFDAISGSMTDNQIGIFET<br>LQKIYSAISLLDILNGSSNVVDAKNALYDKHKRDLNLYFKFLNTLPDEIA<br>KTLKAGYTLYIGNRKKDLLAARKLLKVNVAKNFSQDDFYKLINKELKSI<br>DKQGLQTRFSEKVGELVAQNNFLPVQRSSDNVFIPYQLNAITFNKILENQ<br>GKYYDFLVKPNPAKKDRKNAPYELSQLMQFTIPYYVGPLVTPEEQVKSGI<br>PKTSRFAWMVRKDNGAITPWNFYDKVDIEATADKFIKRSIAKDSYLLSEL<br>VLPKHSLLYEKYEVFNELSNVSLDGKKLSGGVKQILFNEVFKKTNKVNTS<br>RILKALAKHNIPGSKITGLSNPEEFTSSLQTYNAWKKYFPNQIDNFAYQQD<br>LEKMIEWSTVFEDHKILAKKLDEIEWLDDDQKKFVANTRLRGWGRLSKR<br>LLTGLKDNYGKSIMQRLETTKANFQQIVYKPEFREQIDKISQAAAKNQSL<br>EDILANSYTSPSNRKAIRKTMSVVDEYIKLNHGKEPDKIFLMFQRSEQEK<br>GKQTEARSKQLNRILSQLKADKSANKLFSKQLADEFSNAIKKSKYKLND<br>KQYFYFQQLGRDALTGEVIDYDELYKYTVLHIIPRSKLTDDSQNNKVLTK<br>YKIVDGSVALKFGNSYSDALGMPIKAFWTELNRLKLIPKGKLLNLTTDFS<br>TLNKYQRDGYIARQLVETQQIVKLLATIMQSRFKHTKIIEVRNSQVANIRY<br>QFDYFRIKNLNEYYRGFDAYLAAVVGTYLYKVYPKARRLFVYGQYLKP |

-continued

| Description | Sequence |
| --- | --- |
| | KKTNQENQDMHLDSEKKSQGFNFLWNLLYGKQDQIFVNGTDVIAFNRK<br>DLITKMNTVYNYKSQKISLAIDYHNGAMFKATLFPRNDRDTAKTRKUPK<br>KKDYDTDIYGGYTSNVDGYMLLAEIIKRDGNKQYGFYGVPSRLVSELDT<br>LKKTRYTEYEEKLKEIIKPELGVDLKKIKKIKILKNKVPFNQVIIDKGSKFFI<br>TSTSYRWNYRQLILSAESQQTLMDLVVDPDFSNHKARKDARKNADERLI<br>KVYEEILYQVKNYMPMFVELHRCYEKLVDAQKTFKSLKISDKAMVLNQI<br>LILLHSNATSPVLEKLGYHTRFTLGKKHNLISENAVLVTQSITGLKENHVS<br>IKQML (SEQ ID NO: 130) |
| PdCas9<br>*Pedicoccus*<br>*damnosus*<br>NCBI<br>Reference<br>Sequence:<br>WP_<br>062913273.1<br>Wild type | MTNEKYSIGLDIGTSSIGFAVVNDNNRVIRVKGKNAIGVRLFDEGKAAAD<br>RRSFRTTRRSFRTTRRRLSRRRWRLKLLREIFDAYITPVDEAFFIRLKESNL<br>SPKDSKKQYSGDILFNDRSDKDFYEKYPTIYHLRNALMTEHRKFDVREIY<br>LAIHHIMKFRGHFLNATPANNFKVGRLNLEEKFEELNDIYQRVFPDESIEF<br>RTDNLEQIKEVLLDNKRSRADRQRTLVSDIYQSSEDKDIEKRNKAVATEI<br>LKASLGNKAKLNVITNVEVDKEAAKEWSITFDSESIDDDLAKIEGQMTDD<br>GHEIIEVLRSLYSGITLSAIVPENHTLSQSMVAKYDLHKDHLKLFKKLING<br>MTDTKKAKNLRAAYDGYIDGVKGKVLPQEDFYKQVQVNLDDSAEANEI<br>QTYIDQDIFMPKQRTKANGSIPHQLQQQELDQIIENQKAYYPWLAELNPN<br>PDKKRQQLAKYKLDELVTFRVPYYVGPMITAKDQKNQSGAEFAWMIRK<br>EPGNITPWNFDQKVDRMATANQFIKRMTTTDTYLLGEDVLPAQSLLYQK<br>FEVLNELNKIRIDHKPISIEQKQQIFNDLFKQFKNVTIKHLQDYLVSQGQY<br>SKRPLIEGLADEKRFNSSLSTYSDLCGIFGAKLVEENDRQEDLEKIIEWSTI<br>FEDKKIYRAKLNDLTWLTDDQKEKLATKRYQGWGRLSRKLLVGLKNSE<br>HRNIMDILWITNENFMQIQAEPDFAKLVTDANKGMLEKTDSQDVINDLY<br>TSPQNKKAIRQILLVVHDIQNAMHGQAPAKIHVEFARGEERNPRRSVQRQ<br>RQVEAAYEKVSNELVSAKVRQEFKEAINNKRDFKDRLFLYFMQGGIDIY<br>TGKQLNIDQLSSYQIDHILPQAFVKDDSLTNRVLTNENQVKADSVPIDIFG<br>KKMLSVWGRMKDQGLISKGKYRNLTMNPENISAHTENGFINRQLVETRQ<br>VIKLAVNILADEYGDSTQIISVKADLSHQMREDFELLKNRDVNDYHHAFD<br>AYLAAFIGNYLLKRYPKLESYFVYGDFKKFTQKETKMRRFNFIYDLKHC<br>DQVVNKETGEILWTKDEDIKYIRHLFAYKKILVSHEVREKRGALYNQTIY<br>KAKDDKGSGQESKKLIRIKDDKETKIYGGYSGKSLAYMTIVQITKKNKVS<br>YRVIGIPTLALARLNKLENDSTENNGELYKIIKPQFTHYKVDKKNGEIIETT<br>DDFKIVVSKVRFQQLIDDAGQFFMLASDTYKNNAQQLVISNNALKAINN<br>TNITDCPRDDLERLDNLRLDSAFDEIVKKMDKYFSAYDANNFREKIRNSN<br>LIFYQLPVEDQWENNKITELGKRTVLTRILQGLHANATTTDMSIFKIKTPF<br>GQLRQRSGISLSENAQLIYQSPTGLFERRVQLNKIK (SEQ ID NO: 131) |
| FnCas9<br>*Fusobacterium*<br>*nucleatum*<br>NCBI<br>Reference<br>Sequence:<br>WP_<br>060798984.1 | MKKQKFSDYYLGFDIGTNSVGWCVTDLDYNVLRFNKKDMWGSRLFEE<br>AKTAAERRVQRNSRRRLKRRKWRLNLLEEIFSNEILKIDSNFFRRLKESSL<br>WLEDKSSKEKFTLFNDDNYKDYDFYKQYPTIFHLRNELIKNPEKKDIRLV<br>YLAIHSIFKSRGHFLFEGQNLKEIKNFETLYNNLIAFLEDNGINKIIDKNNIE<br>KLEKIVCDSKKGLKDKEKEFKEIFNSDKQLVAIFKLSVGSSVSLNDLFDTD<br>EYKKGEVEKEKISFREQIYEDDKPIYYSILGEKIELLDIAKTFYDFMVLNNI<br>LADSQYISEAKVKLYEEHKKDLKNLKYIIRKYNKGNYDKLFKDKNENNY<br>SAYIGLNKEKSKKEVIEKSRLKIDDLIKNIKGYLPKVEEIEEKDKAIFNKIL<br>NKIELKTILPKQRISDNGTLPYQIHEAELEKILENQSKYYDFLNYEENGIIT<br>KDKLLMTFKFRIPYYVGPLNSYHKDKGGNSWIVRKEEGKILPWNFEQKV<br>DIEKSAEEFIKRMTNKCTYLNGEDVIPKDTFLYSEYVILNELNKVQVNDEF<br>LNEENKRKIIDELFKENKKVSEKKFKEYLLVKQIVDGTIELKGVKDSFNSN<br>YISYIRFKDIFGEKLNLDIYKEISEKSILWKCLYGDDKKIFEKKIKNEYGDIL<br>TKDEIKKINTFKFNNWGRLSEKLLTGIEFINLETGECYSSVMDALRRTNYN<br>LMELLSSKFTLQESINNENKEMNEASYRDLIEESYVSPSLKRAIFQTLKIYE<br>EIRKITGRVPKKVFIEMARGGDESMKNKKIPARQEQLKKLYDSCGNDIAN<br>FSIDIKEMKNSLISYDNNSLRQKKLYLYYLQFGKCMYTGREIDLDRLLQN<br>NDTYDIDHIYPRSKVIKDDSFDNLVLVLKNENAEKSNEYPVKKEIQEKMK<br>SFWRFLKEKNFISDEKYKRLTGKDDFELRGFMARQLVNVRQTTKEVGKI<br>LQQIEPEIKIVYSKAEIASSFREMFDFIKVRELNDTHHAKDAYLNIVAGNV<br>YNTKFTEKPYRYLQEIKENYDVKKIYNYDIKNAWDKENSLEIVKKNMEK<br>NTVNITRFIKEKKGQLFDLNPIKKGETSNEIISIKPKVYNGKDDKLNEKYG<br>YYKSLNPAYFLYVEHKEKNKRIKSFERVNLVDVNNIKDEKSLVKYLIENK<br>KLVEPRVIKKVYKRQVILINDYPYSIVTLDSNKLMDFENLKPLFLENKYE<br>KILKNVIKFLEDNQGKSEENYKFIYLKKKDRYEKNETLESVKDRYNLEFN<br>EMYDKFLEKLDSKDYKNYMNNKKYQELLDVKEKFIKLNLFDKAFTLKS<br>FLDLFNRKTMADFSKVGLTKYLGKIQKISSNVLSKNELYLLEESVTGLFV<br>KKIKL (SEQ ID NO: 132) |
| EcCas9<br>*Enterococcus*<br>*cecorum*<br>NCBI<br>Reference<br>Sequence:<br>WP_<br>047338501.1<br>Wild type | RRKQRIQILQELLGEEVLKTDPGFFHRMKESRYVVEDKRTLDGKQVELPY<br>ALFVDKDYTDKEYYKQFPTINHLIVYLMTTSDTPDIRLVYLALHYYMKN<br>RGNFLHSGDINNVKDINDILEQLDNVLETFLDGWNLKLKSYVEDIKNIYN<br>RDLGRGERKKAFVNTLGAKTKAEKAFCSLISGGSTNLAELFDDSSLKEIE<br>TPKIEFASSSLEDKIDGIQEALEDRFAVIEAAKRLYDWKTLTDILGDSSSLA<br>EARVNSYQMHHEQLLELKSLVKEYLDRKVFQEVFVSLNVANNYPAYIG<br>HTKINGKKKELEVKRTKRNDFYSYVKKQVIEPIKKKVSDEAVLTKLSEIE<br>SLIEVDKYLPLQVNSDNGVIPYQVKLNELTRIFDNLENRIPVLRENRDKIIK<br>TFKFRIPYYVGSLNGVVKNGKCTNWMVRKEEGKIYPWNFEDKVDLEAS<br>AEQFIRRMTNKCTYLVNEDVLPKYSLLYSKYLVLSELNNLRIDGRPLDVK |

-continued

| Description | Sequence |
|---|---|
| | IKQDIYENVFKKNRKVTLKKIKKYLLKEGIITDDDELSGLADDVKSSLTA |
| | YRDFKEKLGHLDLSEAQMENIILNITLFGDDKKLLKKRLAALYPFIDDKSL |
| | NRIATLNYRDWGRLSERFLSGITSVDQETGELRTIIQCMYETQANLMQLL |
| | AEPYHFVEAIEKENPKVDLESISYRIVNDLYVSPAVKRQIWQTLLVIKDIK |
| | QVMKHDPERIFIEMAREKQESKKTKSRKQVLSEVYKKAKEYEHLFEKLN |
| | SLTEEQLRSKKIYLYFTQLGKCMYSGEPIDFENLVSANSNYDIDHIYPQSK |
| | TIDDSFNNIVLVKKSLNAYKSNHYPIDKNIRDNEKVKTLWNTLVSKGLIT |
| | KEKYERLIRSTPFSDEELAGFIARQLVETRQSTKAVAEILSNWFPESEIVYS |
| | KAKNVSNFRQDFEILKVRELNDCHHAHDAYLNIVVGNAYHTKFTNSPYR |
| | FIKNKANQEYNLRKLLQKVNKIESNGVVAWVGQSENNPGTIATVKKVIR |
| | RNTVLISRMVKEVDGQLFDLTLMKKGKGQVPIKSSDERLTDISKYGGYN |
| | KATGAYFTFVKSKKRGKVVRSFEYVPLHLSKQFENNNELLKEYIEKDRG |
| | LTDVEILIPKVLINSLFRYNGSLVRITGRGDTRLLLVHEQPLYVSNSFVQQL |
| | KSVSSYKLKKSENDNAKLTKTATEKLSNIDELYDGLLRKLDLPIYSYWFS |
| | SIKEYLVESRTKYIKLSIEEKALVIFEILHLFQSDAQVPNLKILGLSTKPSRIR |
| | IQKNLKDTDKMSIIHQSPSGIFEHEIELTSL (SEQ ID NO: 133) |
| AhCas9 | MQNGFLGITVSSEQVGWAVTNPKYELERASRKDLWGVRLFDKAETAED |
| *Anaerostipes* | RRMFRTNRRLNQRKKNRIHYLRDIFHEEVNQKDPNFFQQLDESNFCEDD |
| *hadrus* | RTVEFNFDTNLYKNQFPTVYHLRKYLMETKDKPDIRLVYLAFSKFMKNR |
| NCBI | GHFLYKGNLGEVMDFENSMKGFCESLEKFNIDFPTLSDEQVKEVRDILCD |
| Reference | HKIAKTVKKKNIITITKVKSKTAKAWIGLFCGCSVPVKVLFQDIDEEIVTD |
| Sequence: | PEKISFEDASYDDYIANIEKGVGIYYEAIVSAKMLFDWSILNEILGDHQLLS |
| WP_ | DAMIAEYNKHHDDLKRLQKIIKGTGSRELYQDIFINDVSGNYVCYVGHA |
| 044924278.1 | KTMSSADQKQFYTFLKNRLKNVNGISSEDAEWIDTEIKNGTLLPKQTKRD |
| Wild type | NSVIPHQLQLREFELILDNMQEMYPFLKENREKLLKIFNFVIPYYVGPLKG |
| | VVRKGESTNWMVPKKDGVIHPWNFDEMVDKEASAECFISRMTGNCSYL |
| | FNEKVLPKNSLLYETFEVLNELNPLKINGEPISVELKQRIYEQLFLTGKKV |
| | TKKSLTKYLIKNGYDKDIELSGIDNEFHSNLKSHIDFEDYDNLSDEEVEQII |
| | LRITVFEDKQLLKDYLNREFVKLSEDERKQICSLSYKGWGNLSEMLLNGI |
| | TVTDSNGVEVSVMDMLWNTNLNLMQILSKKYGYKAEIEHYNKEHEKTI |
| | YNREDLMDYLNIPPAQRRKVNQLITIVKSLKKTYGVPNKIFFKISREHQDD |
| | PKRTSSRKEQLKYLYKSLKSEDEKHLMKELDELNDHELSNDKVYLYFLQ |
| | KGRCIYSGKKLNLSRLRKSNYQNDIDYIYPLSAVNDRSMNNKVLTGIQEN |
| | RADKYTYFPVDSEIQKKMKGFWMELVLQGFMTKEKYFRLSRENDFSKSE |
| | LVSFIEREISDNQQSGRMIASVLQYYFPESKIVFVKEKLISSFKRDFHLISSY |
| | GHNHLQAAKDAYITIVVGNVYHTKFTMDPAIYFKNHKRKDYDLNRLFLE |
| | NISRDGQIAWESGPYGSIQTVRKEYAQNHIAVTKRVVEVKGGLFKQMPL |
| | KKGHGEYPLKTNDPRFGNIAQYGGYTNVTGSYFVLVESMEKGKKRISLE |
| | YVPVYLHERLEDDPGHKLLKEYLVDHRKLNHPKILLAKVRKNSLLKIDG |
| | FYYRLNGRSGNALILTNAVELIMDDWQTKTANKISGYMKRRAIDKKARV |
| | YQNEFHIQELEQLYDFYLDKLKNGVYKNRKNNQAELIHNEKEQFMELKT |
| | EDQCVLLTEIKKLFVCSPMQADLTLIGGSKHTGMIAMSSNVTKADFAVIA |
| | EDPLGLRNKVIYSHKGEK (SEQ ID NO: 134) |
| KvCas9 | MSQNNNKIYNIGLDIGDASVGWAVVDEHYNLLKRHGKHMWGSRLFTQ |
| *Kandleria* | ANTAVERRSSRSTRRRYNKRRERIRLLREIMEDMVLDVDPTFFIRLANVSF |
| *vitulina* | LDQEDKKDYLKENYHSNYNLFIDKDFNDKTYYDKYPTIYHLRKHLCESK |
| NCBI | EKEDPRLIYLALHHIVKYRGNFLYEGQKFSMDVSNIEDKMIDVLRQFNEI |
| Reference | NLFEYVEDRKKIDEVLNVLKEPLSKKHKAEKAFALFDTTKDNKAAYKEL |
| Sequence: | CAALAGNKFNVTKMLKEAELHDEDEKDISFKFSDATFDDAFVEKQPLLG |
| WP_ | DCVEFIDLLHDIYSWVELQNILGSAHTSEPSISAAMIQRYEDHKNDLKLLK |
| 031589969.1 | DVIRKYLPKKYFEVFRDEKSKKNNYCNYINHPSKTPVDEFYKYIKKLIEKI |
| Wild type | DDPDVKTILNKIELESFMLKQNSRTNGAVPYQMQLDELNKILENQSVYYS |
| | DLKDNEDKIRSILTFRIPYYFGPLNITKDRQFDWIIKKEGKENERILPWNAN |
| | EIVDVDKTADEFIKRMRNFCTYFPDEPVMAKNSLTVSKYEVLNEINKLRI |
| | NDHLIKRDMKDKMLHTLFMDHKSISANAMKKWLVKNQYFSNTDDIKIE |
| | GFQKENACSTSLTPWIDFTKIFGKINESNYDFIEKIIYDVTVFEDKKILRRR |
| | LKKEYDLDEEKIKKILKLKYSGWSRLSKKLLSGIKTKYKDSTRTPETVLE |
| | VMERTNMNLMQVINDEKLGFKKTIDDANSTSVSGKFSYAEVQELAGSPA |
| | IKRGIWQALLIVDEIKKIMKHEPAHVYIEFARNEDEKERKDSFVNQMLKL |
| | YKDYDFEDETEKEANKHLKGEDAKSKIRSERLKLYYTQMGKCMYTGKS |
| | LDIDRLDTYQVDHIVPQSLLKDDSIDNKVLVLSSENQRKLDDLVIPSSIRN |
| | KMYGFWEKLFNNKIISPKKFYSLIKTEFNEKDQERFINRQIVETRQITKHV |
| | AQIIDNHYENTKVVTVRADLSHQFRERYHIYKNRDINDFHHAHDAYIATI |
| | LGTYIGHRFESLDAKYIYGEYKRIFRNQKNKGKEMKKNNDGFILNSMRNI |
| | YADKDTGEIVWDPNYIDRIKKCFYYKDCFVTKKLEENNGTFFNVTVLPN |
| | DTNSDKDNTLATVPVNKYRSNVNKYGGFSGVNSFIVAIKGKKKKGKKVI |
| | EVNKLTGIPLMYKNADEEIKINYLKQAEDLEEVQIGKEILKNQLIEKDGGL |
| | YYIVAPTEIINAKQLILNESQTKLVCEIYKAMKYKNYDNLDSEKIIDLYRL |
| | LINKMELYYPEYRKQLVKKFEDRYEQLKVISIEEKCNIIKQILATLHCNSSI |
| | GKIMYSDFKISTTIGRLNGRTISLDDISFIAESPTGMYSKKYKL |
| | (SEQ ID NO: 135) |
| EfCas9 | MRLFEEGHTAEDRRLKRTARRRISRRRNRLRYLQAFFEEAMTDLDENFF |
| *Enterococcus* | ARLQESFLVPEDKKWHRHPIFAKLEDEVAYHETYPTIYHLRKKLADSSEQ |
| *faecalis* | ADLRLIYLALAHIVKYRGHFLIEGKLSTENTSVKDQFQQFMVIYNQTFVN |

-continued

| Description | Sequence |
| --- | --- |
| NCBI<br>Reference<br>Sequence:<br>WP_<br>016631044.1<br>Wild type | GESRLVSAPLPESVLIEEELTEKASRTKKSEKVLQQFPQEKANGLFGQFLK<br>LMVGNKADFKKVFGLEEEAKITYASESYEEDLEGILAKVGDEYSDVFLA<br>AKNVYDAVELSTILADSDKKSHAKLSSSMIVRFTEHQEDLKKFKRFIREN<br>CPDEYDNLFKNEQKDGYAGYIAHAGKVSQLKFYQYVKKIIQDIAGAEYF<br>LEKIAQENFLRKQRTFDNGVIPHQIHLAELQAIIHRQAAYYPFLKENQEKI<br>EQLVTFRIPYYVGPLSKGDASTFAWLKRQSEEPIRPWNLQETVDLDQSAT<br>AFIERMTNFDTYLPSEKVLPKHSLLYEKFMVFNELTKISYTDDRGIKANFS<br>GKEKEKIFDYLFKTRRKVKKKDIIQFYRNEYNTEIVTLSGLEEDQFNASFS<br>TYQDLLKCGLTRAELDHPDNAEKLEDIIKILTIFEDRQRIRTQLSTFKGQFS<br>AEVLKKLERKHYTGWGRLSKKLINGIYDKESGKTILDYLVKDDGVSKHY<br>NRNFMQLINDSQLSFKNAIQKAQSSEHEETLSETVNELAGSPAIKKGIYQS<br>LKIVDELVAIMGYAPKRIVVEMARENQTTSTGKRRSIQRLKIVEKAMAEI<br>GSNLLKEQPTTNEQLRDTRLFLYYMQNGKDMYTGDELSLHRLSHYDIDH<br>IIPQSFMKDDSLDNLVLVGSTENRGKSDDVPSKEVVKDMKAYWEKLYA<br>AGLISQRKFQRLTKGEQGGLTLEDKAHFIQRQLVETRQITKNVAGILDQR<br>YNAKSKEKKVQIITLKASLTSQFRSIFGLYKVREVNDYHHGQDAYLNCV<br>VATTLLKVYPNLAPEFVYGEYPKFQTFKENKATAKAIIYTNLLRFFTEDEP<br>RFTKDGEILWSNSYLKTIKKELNYHQMNIVKKVEVQKGGFSKESIKPKGP<br>SNKLIPVKNGLDPQKYGGFDSPVVAYTVLFTHEKGKKPLIKQEILGITIME<br>KTRFEQNPILFLEEKGFLRPRVLMKLPKYTLYEFPEGRRRLLASAKEAQK<br>GNQMVLPEHLLTLLYHAKQCLLPNQSESLAYVEQHQPEFQEILERVVDF<br>AEVHTLAKSKVQQIVKLFEANQTADVKEIAASFIQLMQFNAMGAPSTFKF<br>FQKDIERARYTSIKEIFDATIIYQSPTGLYETRRKVVD<br>(SEQ ID NO: 136) |
| *Staphylococcus*<br>*aureus* Cas9 | KRNYILGLDIGITSVGYGIIDYETRDVIDAGVRLFKEANVENNEGRRSKRG<br>ARRLKRRRRHRIQRVKKLLFDYNLLTDHSELSGINPYEARVKGLSQKLSE<br>EEFSAALLHLAKRRGVHNVNEVEEDTGNELSTKEQISRNSKALEEKYVA<br>ELQLERLKKDGEVRGSINTRFKTSDYVKEAKQLLKVQKAYHQLDQSFIDT<br>YIDLLETRRTYYEGPGEGSPFGWKDIKEWYEMLMGHCTYFPEELRSVKY<br>AYNADLYNALNDLNNLVITRDENEKLEYYEKFQIIENVFKQKKKPTLKQI<br>AKEILVNEEDIKGYRVTSTGKPEFTNLKVYHDIKDITARKEIIENAELLDQI<br>AKILTIYQSSEDIQEELTNLNSELTQEEIEQISNLKGYTGTHNLSLKAINLIL<br>DELWHTNDNQIAIFNRLKLVPKKVDLSQQKEIPTTLVDDFILSPVVKRSFI<br>QSIKVINAIIKKYGLPNDIIIELAREKNSKDAQKMINEMQKRNRQTNERIEE<br>IIRTTGKENAKYLIEKIKLHDMQEGKCLYSLEAIPLEDLLNNPFNYEVDHII<br>PRSVSFDNSFNNKVLVKQEENSKKGNRTPFQYLSSSDSKISYETFKKHILN<br>LAKGKGRISKTKKEYLLEERDINRFSVQKDFINRNLVDTRYATRGLMNLL<br>RSYFRVNNLDVKVKSINGGFTSFLRRKWKFKKERNKGYKHHAEDALIIA<br>NADFIFKEWKKLDKAKKVMENQMFEEKQAESMPEIETEQEYKEIFITPHQ<br>IKHIKDFKDYKYSHRVDKKPNRELINDTLYSTRKDDKGNTLIVNNLNGLY<br>DKDNDKLKKLINKSPEKLLMYHHDPQTYQKLKLIMEQYGDEKNPLYKY<br>YEETGNYLTKYSKKDNGPVIKKIKYYGNKLNAHLDITDDYPNSRNKVVK<br>LSLKPYRFDVYLDNGVYKFVTVKNLDVIKKENYYEVNSKCYEEAKKLK<br>KISNQAEFIASFYNNDLIKINGELYRVIGVNNDLLNRIEVNMIDITYREYLE<br>NMNDKRPPRIIKTIASKTQSIKKYSTDILGNLYEVKSKKHPQIIKKG<br>(SEQ ID NO: 137) |
| *Geobacillus*<br>*thermodenhrificans*<br>Cas9 | MKYKIGLDIGITSIGWAVINLDIPRIEDLGVRIFDRAENPKTGESLALPRRL<br>ARSARRRLRRRKHRLERIRRLFVREGILTKEELNKLFEKKHEIDVWQLRV<br>EALDRKLNNDELARILLHLAKRRGFRSNRKSERTNKENSTMLKHIEENQS<br>ILSSYRTVAEMVVKDPKFSLHKRNKEDNYTNTVARDDLEREIKLIFAKQR<br>EYGNIVCTEAFEHEYISIWASQRPFASKDDIEKKVGFCTFEPKEKRAPKAT<br>YTFQSFTVWEHINKLRLVSPGGIRALTDDERRLIYKQAFHKNKITFHDVR<br>TLLNLPDDTRFKGLLYDRNTTLKENEKVRFLELGAYHKIRKAIDSVYGKG<br>AAKSFRPIDFDTFGYALTMFKDDTDIRSYLRNEYEQNGKRMENLADKVY<br>DEELIEELLNLSFSKFGHLSLKALRNILPYMEQGEVYSTACERAGYTFTGP<br>KKKQKTVLLPNIPPIANPVVMRALTQARKVVNAIIKKYGSPVSIHIELARE<br>LSQSFDERRKMQKEQEGNRKKNETAIRQLVEYGLTLNPTGLDIVKFKLW<br>SEQNGKCAYSLQPIEIERLLEPGYTEVDHVIPYSRSLDDSYTNKVLVLTKE<br>NREKGNRTPAEYLGLGSERWQQFETFVLTNKQFSKKKRDRLLRLHYDEN<br>EENEFKNRNLNDTRYISRFLANFIREHLKFADSDDKQKVYTVNGRITAHL<br>RSRWNFNKNREESNLHHAVDAAIVACTTPSDIARVTAFYQRREQNKELS<br>KKTDPQFPQPWPHFADELQARLSKNPKESIKALNLGNYDNEKLESLQPVF<br>VSRMPKRSITGAAHQETLRRYIGIDERSGKIQTVVKKKLSEIQLDKTGHFP<br>MYGKESDPRTYEAIRQRLLEHNNDPKKAFQEPLYKPKKNGELGPIIRTIKII<br>DTTNQVIPLNDGKTVAYNSNIVRVDVFEKDGKYYCVPIYTIDMMKGILPN<br>KAIEPNKPYSEWKEMTEDYTFRFSLYPNDLIRIEFPREKTIKTAVGEEIKIK<br>DLFAYYQTIDSSNGGLSLVSHDNNFSLRSIGSRTLKRFEKYQVDVLGNIY<br>KVRGEKRVGVASSSHSKAGETIRPL (SEQ ID NO: 138) |
| ScCas9<br>*S. canis*<br>1375 AA<br>159.2 kDa | MEKKYSIGLDIGTNSVGWAVITDDYKVPSKKFKVLGNTNRKSIKKNLMG<br>ALLFDSGETAEATRLKRTARRRYTRRKNRIRYLQEIFANEMAKLDDSFFQ<br>RLEESFLVEEDKKNERHPIFGNLADEVAYHRNYPTIYHLRKKLADSPEKA<br>DLRLIYLALAHIIKFRGHFLIEGKLNAENSDVAKLFYQLIQTYNQLFEESPL<br>DEIEVDAKGILSARLSKSKRLEKLIAVFPNEKKNGLFGNIIALALGLTPNFK<br>SNFDLTEDAKLQLSKDTYDDDLDELLGQIGDQYADLFSAAKNLSDAILLS |

-continued

| Description | Sequence |
|---|---|
| | DILRSNSEVTKAPLSASMVKRYDEHHQDLALLKTLVRQQFPEKYAEIFKD<br>DTKNGYAGYVGIGIKHRKRTTKLATQEEFYKFIKPILEKMDGAEELLAKL<br>NRDDLLRKQRTFDNGSIPHQIHLKELHAILRRQEEFYPFLKENREKIEKILT<br>FRIPYYVGPLARGNSRFAWLTRKSEEAITPWNFEEVVDKGASAQSFIERM<br>TNFDEQLPNKKVLPKHSLLYEYFTVYNELTKVKYVTERMRKPEFLSGEQ<br>KKAIVDLLFKTNRKVTVKQLKEDYFKKIECFDSVEIIGVEDRFNASLGTY<br>HDLLKIIKDKDFLDNEENEDILEDIVLTLTLFEDREMIEERLKTYAHLFDD<br>KVMKQLKRRHYTGWGRLSRKMINGIRDKQSGKTILDFLKSDGFSNRNFM<br>QLIHDDSLTFKEEIEKAQVSGQGDSLHEQIADLAGSPAIKKGILQTVKIVD<br>ELVKVMGHKPENIVIEMARENQTTTKGLQQSRERKKRIEEGIKELESQILK<br>ENPVENTQLQNEKLYLYYLQNGRDMYVDQELDINRLSDYDVDHIVPQSF<br>IKDDSIDNKVLTRSVENRGKSDNVPSEEVVKKMKNYWRQLLNAKLITQR<br>KFDNLTKAERGGLSEADKAGFIKRQLVETRQITKHVARILDSRMNTKRD<br>KNDKPIREVKVITLKSKLVSDFRKDFQLYKVRDINNYHHAHDAYLNAVV<br>GTALIKKYPKLESEFVYGDYKVYDVRKMIAKSEQEIGKATAKRFFYSNIM<br>NFFKTEVKLANGEIRKRPLIETNGETGEVVWNKEKDFATVRKVLAMPQV<br>NIVKKTEVQTGGFSKESILSKRESAKLIPRKKGWDTRKYGGFGSPTVAYSI<br>LVVAKVEKGKAKKLKSVKVLVGITIMEKGSYEKDPIGFLEAKGYKDIKK<br>ELIFKLPKYSLFELENGRRRMLASATELQKANELVLPQHLVRLLYYTQNI<br>SATTGSNNLGYIEQHREEFKEIFEKIIDFSEKYILKNKVNSNLKSSFDEQFA<br>VSDSILLSNSFVSLLKYTSFGASGGFTFLDLDVKQGRLRYQTVTEVLDAT<br>LIYQSITGLYETRTDLSQLGGD (SEQ ID NO: 139) |

The base editors described herein may include any of the above Cas9 ortholog sequences, or any variants thereof having at least 80%, at least 85%, at least 90%, at least 95%, or at least 99% sequence identity thereto.

The napDNAbp may include any suitable homologs and/or orthologs or naturally occurring enzymes, such as Cas9. Cas9 homologs and/or orthologs have been described in various species, including, but not limited to, *S. pyogenes* and *S. thermophilus*. Preferably, the Cas moiety is configured (e.g, mutagenized, recombinantly engineered, or otherwise obtained from nature) as a nickase, i.e., capable of cleaving only a single strand of the target doubpdditional suitable Cas9 nucleases and sequences will be apparent to those of skill in the art based on this disclosure, and such Cas9 nucleases and sequences include Cas9 sequences from the organisms and loci disclosed in Chylinski, Rhun, and Charpentier, "The tracrRNA and Cas9 families of type II CRISPR-Cas immunity systems" (2013) RNA Biology 10:5, 726-737; the entire contents of which are incorporated herein by reference. In some embodiments, a Cas9 nuclease has an inactive (e.g., an inactivated) DNA cleavage domain, that is, the Cas9 is a nickase. In some embodiments, the Cas9 protein comprises an amino acid sequence that is at least 80% identical to the amino acid sequence of a Cas9 protein as provided by any one of the variants of Table 3. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the Cas9 orthologs in the above tables.

Dead napDNAbp Variants

In some embodiments, the disclosed base editors may comprise a catalytically inactive, or "dead," napDNAbp domain. Exemplary catalytically inactive domains in the disclosed base editors are dead *S. pyogenes* Cas9 (dSpCas9) and *S. pyogenes* Cas9 nickase (SpCas9n).

In certain embodiments, the base editors described herein may include a dead Cas9, e.g., dead SpCas9, which has no nuclease activity due to one or more mutations that inactivate both nuclease domains of SpCas9, namely the RuvC domain (which cleaves the non-protospacer DNA strand) and HNH domain (which cleaves the protospacer DNA strand).

The nuclease inactivation may be due to one or mutations that result in one or more substitutions and/or deletions in the amino acid sequence of the encoded protein, or any variants thereof having at least 80%, at least 85%, at least 90%, at least 95%, or at least 99% sequence identity thereto.

In certain embodiments, the base editors described herein may include a dead Cas9, e.g., dead SpCas9, which has no nuclease activity due to one or more mutations that inactivate both nuclease domains of SpCas9, namely the RuvC domain (which cleaves the non-protospacer DNA strand) and HNH domain (which cleaves the protospacer DNA strand). The D10A and N580A mutations in the wild-type *S. aureus* Cas9 amino acid sequence may be used to form a dSaCas9. Accordingly, in some embodiments, the napDNAbp domain of the base editors provided herein comprises a dSaCas9 that has D10A and N580A mutations relative to the wild-type SaCas9 sequence (SEQ ID NO: 127).

As used herein, the term "dCas9" refers to a nuclease-inactive Cas9 or nuclease-dead Cas9, or a functional fragment thereof, and embraces any naturally occurring dCas9 from any organism, any naturally-occurring dCas9 equivalent or functional fragment thereof, any dCas9 homolog, ortholog, or paralog from any organism, and any mutant or variant of a dCas9, naturally-occurring or engineered. The term dCas9 is not meant to be particularly limiting and may be referred to as a "dCas9 or equivalent." Exemplary dCas9 proteins and method for making dCas9 proteins are further described herein and/or are described in the art and are incorporated herein by reference.

In other embodiments, dCas9 corresponds to, or comprises in part or in whole, a Cas9 amino acid sequence having one or more mutations that inactivate the Cas9 nuclease activity. In other embodiments, Cas9 variants having mutations other than D10A and H840A are provided which may result in the full or partial inactivate of the endogenous Cas9 nuclease activity (e.g., nCas9 or dCas9, respectively). Such mutations, by way of example, include other amino acid substitutions at D10 and H820, or other substitutions within the nuclease domains of Cas9 (e.g., substitutions in the HNH nuclease subdomain and/or the RuvC1 subdomain) with reference to a wild type sequence such as Cas9 from *Streptococcus pyogenes* (NCBI Reference Sequence: NC_017053.1). In some embodiments, variants or homologues of Cas9 (e.g., variants of Cas9 from *Streptococcus pyogenes* (NCBI Reference Sequence: NC_017053.1)) are provided which are at least about 70% identical, at least about 80% identical, at least about 90% identical, at least about 95% identical, at least about 98% identical, at least about 99% identical, at least about 99.5% identical, or at least about 99.9% identical to NCBI Reference Sequence: NC_017053.1. In some embodiments, variants of dCas9 (e.g., variants of NCBI Reference Sequence: NC_017053.1) are provided having amino acid sequences which are shorter, or longer than NC_017053.1 by about 5 amino acids, by about 10 amino acids, by about 15 amino acids, by about 20 amino acids, by about 25 amino acids, by about 30 amino acids, by about 40 amino acids, by about 50 amino acids, by about 75 amino acids, by about 100 amino acids or more.

In some embodiments, the napDNAbp domain of any of the disclosed base editors comprises a dead *S. pyogenes* Cas9 (dSpCas9). In some embodiments, the napDNAbp domain of any of the disclosed based editors is comprises at least 80%, at least 85%, at least 90%, at least 95%, or at least 99% sequence identity to SEQ ID NO: 108. In some embodiments, the napDNAbp domain of any of the disclosed base editors comprises the amino acid sequence of SEQ ID NO: 108.

In one embodiment, the dead Cas9 may be based on the canonical SpCas9 sequence of Q99ZW2 and may have the following sequence, which comprises a D10A and an H810A substitutions (underlined and bolded), or a variant of SEQ ID NO: 108 having at least 80%, at least 85%, at least 90%, at least 95%, or at least 99% sequence identity thereto:

| Description | Sequence | SEQ ID NO: |
|---|---|---|
| dead Cas9 or dCas9 *Streptococcus pyogenes* Q99ZW2 Cas9 with D10X and H810x Where "X" is any amino acid | MDKKYSIGLXIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDXIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | SEQ ID NO: 140 |
| dead Cas9 or dCas9 *Streptococcus pyogenes* Q99ZW2 Cas9 with D10A and H810A | MDKKYSIGLAIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDAIVPQSFLKDDSIDNKVLTRSDKNRGKSDNV | SEQ ID NO: 108 |

-continued

| Description | Sequence | SEQ ID NO: |
|---|---|---|
| | PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG GFSKESILPKRNSDKLIARKKDWDPKKYGGFDSPTVAYS VLVVAKVEKGKSKKLKSVKELLGITIMERSSFEKNPIDFL EAKGYKEVKKDLIIKLPKYSLFELENGRKRMLASAGELQ KGNELALPSKYVNFLYLASHYEKLKGSPEDNEQKQLFVE QHKHYLDEIIEQISEFSKRVILADANLDKVLSAYNKHRDK PIREQAENIIHLFTLTNLGAPAAFKYFDTTIDRKRYTSTKE VLDATLIHQSITGLYETRIDLSQLGGD | |
| dead *Lachno-spiraceae bacterium* Cas12a | MSKLEKFTNCYSLSKTLRFKAIPVGKTQENIDNKRLLVED EKRAEDYKGVKKLLDRYYLSFINDVLHSIKLKNLNNYISL FRKKTRTEKENKELENLEINLRKEIAKAFKGNEGYKSLFK KDIIETILPEFLDDKDEIALVNSFNGFTTAFTGFFDNRENM FSEEAKSTSIAFRCINENLTRYISNMDIFEKVDAIFDKHEV QEIKEKILNSDYDVEDFFEGEFFNFVLTQEGIDVYNAIIGG FVTESGEKIKGLNEYINLYNQKTKQKLPKFKPLYKQVLSD RESLSFYGEGYTSDEEVLEVFRNTLNKNSEIFSSIKKLEKL FKNFDEYSSAGIFVKNGPAISTISKDIFGEWNVIRDKWNA EYDDIHLKKKAVVTEKYEDDRRKSFKKIGSFSLEQLQEY ADADLSVVEKLKEIIIQKVDEIYKVYGSSEKLFDADFVLE KSLKKNDAVVAIMKDLLDSVKSFENYIKAFFGEGKETNR DESFYGDFVLAYDILLKVDHIYDAIRNYVTQKPYSKDKF KLYFQNPQFMGGWDKDKETDYRATILRYGSKYYLAIMD KKYAKCLQKIDKDDVNGNYEKINYKLLPGPNKMLPKVF FSKKWMAYYNPSEDIQKIYKNGTFKKGDMFNLNDCHKL IDFFKDSISRYPKWSNAYDFNFSETEKYKDIAGFYREVEE QGYKVSFESASKKEVDKLVEEGKLYMFQIYNKDFSDKSH GTPNLHTMYFKLLFDENNHGQIRLSGGAELFMRRASLKK EELVVHPANSPIANKNPDNPKKTTTLSYDVYKDKRFSED QYELHIPIAINKCPKNIFKINTEVRVLLKHDDNPYVIGIAR GERNLLYIVVVDGKGNIVEQYSLNEIINNFNGIRIKTDYHS LLDKKEKERFEARQNWTSIENIKELKAGYISQVVHKICEL VEKYDAVIALEDLNSGFKNSRVKVEKQVYQKFEKMLID KLNYMVDKKSNPCATGGALKGYQITNKFESFKSMSTQN GFIFYIPAWLTSKIDPSTGFVNLLKTKYTSIADSKKFISSFD RIMYVPEEDLFEFALDYKNFSRTDADYIKKWKLYSYGNR IRIFRNPKKNNVFDWEEVCLTSAYKELFNKYGINYQQGDI RALLCEQSDKAFYSSFMALMSLMLQMRNSITGRTDVDFL ISPVKNSDGIFYDSRNYEAQENAILPKNADANGAYNIARK VLWAIGQFKKAEDEKLDKVKIAISNKEWLEYAQTSVK | SEQ ID NO: 142 |

napDNAbp Nickase Variants In some embodiments, the disclosed base editors may comprise a napDNAbp domain that comprises a nickase. In some embodments, the base editors described herein comprise a Cas9 nickase. The term "Cas9 nickase" of "nCas9" refers to a variant of Cas9 which is capable of introducing a single-strand break in a double strand DNA molecule target. In some embodiments, the Cas9 nickase comprises only a single functioning nuclease domain. The wild type Cas9 (e.g., the canonical SpCas9) comprises two separate nuclease domains, namely, the RuvC domain (which cleaves the non-protospacer DNA strand) and HNH domain (which cleaves the protospacer DNA strand). In one embodiment, the Cas9 nickase comprises a mutation in the RuvC domain which inactivates the RuvC nuclease activity. For example, mutations in aspartate (D) 10, histidine (H) 983, aspartate (D) 986, or glutamate (E) 762, have been reported as loss-of-function mutations of the RuvC nuclease domain and the creation of a functional Cas9 nickase (e.g., Nishimasu et al., "Crystal structure of Cas9 in complex with guide RNA and target DNA," Cell 156(5), 935-949, which is incorporated herein by reference). Thus, nickase mutations in the RuvC domain could include D10X, H983X, D986X, or E762X, wherein X is any amino acid other than the wild type amino acid. In certain embodiments, the nickase could be D10A, of H983A, or D986A, or E762A, or a combination thereof.

In some embodiments, the napDNAbp domain of any of the disclosed base editors comprises an *S. pyogenes* Cas9 nickase (SpCas9n). In some embodiments, the napDNAbp domain of any of the disclosed based editors is comprises at least 80%, at least 85%, at least 90%, at least 95%, or at least 99% sequence identity to SEQ ID NO: 109 or 153. In some embodiments, the napDNAbp domain of any of the disclosed base editors comprises the amino acid sequence of SEQ ID NO: 109. In some embodiments, the napDNAbp domain of any of the disclosed base editors comprises the amino acid sequence of SEQ ID NO: 153.

In some embodiments, the napDNAbp domain of any of the disclosed base editors comprises an *S. aureus* Cas9 nickase (SaCas9n). In some embodiments, the napDNAbp domain of any of the disclosed based editors is comprises at least 80%, at least 85%, at least 90%, at least 95%, or at least 99% sequence identity to SEQ ID NO: 151. In some embodiments, the napDNAbp domain of any of the disclosed base editors comprises the amino acid sequence of SEQ ID NO: 151.

In various embodiments, the Cas9 nickase can having a mutation in the RuvC nuclease domain and have one of the following amino acid sequences, or a variant thereof having an amino acid sequence that has at least 80%, at least 85%, at least 90%, at least 95%, or at least 99% sequence identity thereto.

| Description | Sequence | SEQ ID NO: |
|---|---|---|
| Cas9nickase *Streptococcus pyogenes* Q99ZW2 Cas9 with D10X, wherein X is any alternate amino acid | MDKKYSIGLXIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRED LLRKQRTFDNGSIPHQIHLGELHAILRRQEDFYPFLKDNR EKIEKILTFRIPYYVGPLARGNSRFAWMTRKSEETITPWNF EEVVDKGASAQSFIERMTNFDKNLPNEKVLPKHSLLYEY FTVYNELTKVKYVTEGMRKPAFLSGEQKKAIVDLLFKTN RKVTVKQLKEDYFKKIECFDSVETSGVEDRFNASLGTYH DLLKIIKDKDFLDNEENEDILEDIVLTLTLFEDREMIEERL KTYAHLFDDKVMKQLKRRRYTGWGRLSRKLINGIRDKQ SGKTILDFLKSDGFANRNFMQLIHDDSLTFKEDIQKAQVS GQGDSLHEHIANLAGSPAIKKGILQTVKVVDELVKVMGR HKPENIVIEMARENQTTQKGQKNSRERMKRIEEGIKELGS QILKEHPVENTQLQNEKLYLYYLQNGRDMYVDQELDIN RLSDYDVDHIVPQSFLKDDSIDNKVLTRSDKNRGKSDNV PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG GFSKESILPKRNSDKLIARKKDWDPKKYGGFDSPTVAYS VLVVAKVEKGKSKKLKSVKELLGITIMERSSFEKNPIDFL EAKGYKEVKKDLIIKLPKYSLFELENGRKRMLASAGELQ KGNELALPSKYVNFLYLASHYEKLKGSPEDNEQKQLFVE QHKHYLDEIIEQISEFSKRVILADANLDKVLSAYNKHRDK PIREQAENIIHLFTLTNLGAPAAFKYFDTTIDRKRYTSTKE VLDATLIHQSITGLYETRIDLSQLGGD | SEQ ID NO: 143 |
| Cas9 nickase *Streptococcus pyogenes* Q99ZW2 Cas9 with E762X, wherein X is any alternate amino acid | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRED LLRKQRTFDNGSIPHQIHLGELHAILRRQEDFYPFLKDNR EKIEKILTFRIPYYVGPLARGNSRFAWMTRKSEETITPWNF EEVVDKGASAQSFIERMTNFDKNLPNEKVLPKHSLLYEY FTVYNELTKVKYVTEGMRKPAFLSGEQKKAIVDLLFKTN RKVTVKQLKEDYFKKIECFDSVETSGVEDRFNASLGTYH DLLKIIKDKDFLDNEENEDILEDIVLTLTLFEDREMIEERL KTYAHLFDDKVMKQLKRRRYTGWGRLSRKLINGIRDKQ SGKTILDFLKSDGFANRNFMQLIHDDSLTFKEDIQKAQVS GQGDSLHEHIANLAGSPAIKKGILQTVKVVDELVKVMGR HKPENIVIXMARENQTTQKGQKNSRERMKRIEEGIKELGS QILKEHPVENTQLQNEKLYLYYLQNGRDMYVDQELDIN RLSDYDVDHIVPQSFLKDDSIDNKVLTRSDKNRGKSDNV PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG GFSKESILPKRNSDKLIARKKDWDPKKYGGFDSPTVAYS VLVVAKVEKGKSKKLKSVKELLGITIMERSSFEKNPIDFL EAKGYKEVKKDLIIKLPKYSLFELENGRKRMLASAGELQ KGNELALPSKYVNFLYLASHYEKLKGSPEDNEQKQLFVE QHKHYLDEIIEQISEFSKRVILADANLDKVLSAYNKHRDK PIREQAENIIHLFTLTNLGAPAAFKYFDTTIDRKRYTSTKE VLDATLIHQSITGLYETRIDLSQLGGD | SEQ ID NO: 144 |
| Cas9 nickase *Streptococcus pyogenes* Q99ZW2 Cas9 with H983X, wherein X is | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN | SEQ ID NO: 145 |

-continued

| Description | Sequence | SEQ ID NO: |
|---|---|---|
| any alternate<br>amino acid | LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHXAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | |
| Cas9 nickase<br>*Streptococcus*<br>*pyogenes*<br>Q99ZW2<br>Cas9 with<br>D986X,<br>wherein X is<br>any alternate<br>amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHX<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | SEQ ID NO:<br>146 |
| Cas9 nickase<br>*Streptococcus*<br>*pyogenes*<br>Q99ZW2<br>Cas9 with<br>D10A | MDKKYSIGLAIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF | SEQ ID NO:<br>109 |

-continued

| Description | Sequence | SEQ ID NO: |
|---|---|---|
| | EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | |
| Cas9 nickase<br>*Streptococcus*<br>*pyogenes*<br>Q99ZW2<br>Cas9 with<br>E762A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIAMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | SEQ ID NO:<br>148 |
| Cas9 nickase<br>*Streptococcus*<br>*pyogenes*<br>Q99ZW2<br>Cas9 with<br>H983A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ | SEQ ID NO:<br>149 |

-continued

| Description | Sequence | SEQ ID NO: |
|---|---|---|
| | SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | |
| Cas9 nickase<br>*Streptococcus*<br>*pyogenes*<br>Q99ZW2<br>Cas9 with<br>D986A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVETSGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDHIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHA<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | SEQ ID NO:<br>150 |
| Cas9 nickase<br>*Staphylococcus*<br>*aureus*<br>(SaCas9)<br>with D10A | MGKRNYILGLAIGITSVGYGIIDYETRDVIDAGVRLFKEA<br>NVENNEGRRSKRGARRLKRRRRHRIQRVKKLLFDYNLLT<br>DHSELSGINPYEARVKGLSQKLSEEEFSAALLHLAKRRGV<br>HNVNEVEEDTGNELSTKEQISRNSKALEEKYVAELQLER<br>LKKDGEVRGSINRFKTSDYVKEAKQLLKVQKAYHQLDQ<br>SFIDTYIDLLETRRTYYEGPGEGSPFGWKDIKEWYEMLM<br>GHCTYFPEELRSVKYAYNADLYNALNDLNNLVITRDENE<br>KLEYYEKFQIIENVFKQKKKPTLKQIAKEILVNEEDIKGYR<br>VTSTGKPEFTNLKVYHDIKDITARKEIIENAELLDQIAKILT<br>IYQSSEDIQEELTNLNSELTQEEIEQISNLKGYTGTHNLSL<br>KAINLILDELWHTNDNQIAIFNRLKLVPKKVDLSQQKEIP<br>TTLVDDFILSPVVKRSFIQSIKVINAIIKKYGLPNDIIIELAR<br>EKNSKDAQKMINEMQKRNRQTNERIEEIIRTTGKENAKY<br>LIEKIKLHDMQEGKCLYSLEAIPLEDLLNNPFNYEVDHIIP<br>RSVSFDNSFNNKVLVKQEENSKKGNRTPFQYLSSSDSKIS<br>YETFKKHILNLAKGKGRISKTKKEYLLEERDINRFSVQKD<br>FINRNLVDTRYATRGLMNLLRSYFRVNNLDVKVKSINGG<br>FTSFLRRKWKFKKERNKGYKHHAEDALIIANADFIFKEW<br>KKLDKAKKVMENQMFEEKQAESMPEIETEQEYKEIFITP<br>HQIKHIKDFKDYKYSHRVDKKPNRKLINDTLYSTRKDDK<br>GNTLIVNNLNGLYDKDNDKLKKLINKSPEKLLMYHHDP<br>QTYQKLKLIMEQYGDEKNPLYKYYEETGNYLTKYSKKD | SEQ ID NO:<br>151 |

-continued

| Description | Sequence | SEQ ID NO: |
|---|---|---|
| | NGPVIKKIKYYGNKLNAHLDITDDYPNSRNKVVKLSLKP<br>YRFDVYLDNGVYKFVTVKNLDVIKKENYYEVNSKCYEE<br>AKKLKKISNQAEFIASFYKNDLIKINGELYRVIGVNNDLL<br>NRIEVNMIDITYREYLENMNDKRPPHIIKTIASKTQSIKKY<br>STDILGNLYEVKSKKHPQIIKK | |

In another embodiment, the Cas9 nickase comprises a mutation in the HNH domain which inactivates the HNH nuclease activity. For example, mutations in histidine (H) 840 or asparagine (R) 863 have been reported as loss-of-function mutations of the HNH nuclease domain and the creation of a functional Cas9 nickase (e.g., Nishimasu et al., "Crystal structure of Cas9 in complex with guide RNA and target DNA," Cell 156(5), 935-949, which is incorporated herein by reference). Thus, nickase mutations in the HNH domain could include H840X and R863X, wherein X is any amino acid other than the wild type amino acid. In certain embodiments, the nickase could be H840A or R863A or a combination thereof.

In various embodiments, the Cas9 nickase can have a mutation in the HNH nuclease domain and have one of the following amino acid sequences, or a variant thereof having an amino acid sequence that has at least 80%, at least 85%, at least 90%, at least 95%, or at least 99% sequence identity thereto.

| Description | Sequence | SEQ ID NO: |
|---|---|---|
| Cas9 nickase *Streptococcus pyogenes* Q99ZW2 Cas9 with H840X, wherein X is any alternate amino acid | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ<br>SGKTILDFLKSDGFANRNFMQLIHDDSLTFKEDIQKAQVS<br>GQGDSLHEHIANLAGSPAIKKGILQTVKVVDELVKVMGR<br>HKPENIVIEMARENQTTQKGQKNSRERMKRIEEGIKELGS<br>QILKEHPVENTQLQNEKLYLYYLQNGRDMYVDQELDIN<br>RLSDYDVDXIVPQSFLKDDSIDNKVLTRSDKNRGKSDNV<br>PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | SEQ ID NO: 152 |
| Cas9 nickase *Streptococcus pyogenes* Q99ZW2 Cas9 with H840A | MDKKYSIGLDIGTNSVGWAVITDEYKVPSKKFKVLGNTD<br>RHSIKKNLIGALLFDSGETAEATRLKRTARRRYTRRKNRI<br>CYLQEIFSNEMAKVDDSFFHRLEESFLVEEDKKHERHPIF<br>GNIVDEVAYHEKYPTIYHLRKKLVDSTDKADLRLIYLAL<br>AHMIKFRGHFLIEGDLNPDNSDVDKLFIQLVQTYNQLFEE<br>NPINASGVDAKAILSARLSKSRRLENLIAQLPGEKKNGLF<br>GNLIALSLGLTPNFKSNFDLAEDAKLQLSKDTYDDDLDN<br>LLAQIGDQYADLFLAAKNLSDAILLSDILRVNTEITKAPLS<br>ASMIKRYDEHHQDLTLLKALVRQQLPEKYKEIFFDQSKN<br>GYAGYIDGGASQEEFYKFIKPILEKMDGTEELLVKLNRED<br>LLRKQRTFDNGSIPHQIHLGELHAILRRQEDFYPFLKDNR<br>EKIEKILTFRIPYYVGPLARGNSRFAWMTRKSEETITPWNF<br>EEVVDKGASAQSFIERMTNFDKNLPNEKVLPKHSLLYEY<br>FTVYNELTKVKYVTEGMRKPAFLSGEQKKAIVDLLFKTN<br>RKVTVKQLKEDYFKKIECFDSVEISGVEDRFNASLGTYH<br>DLLKIIKDKDFLDNEENEDILEDIVLTLTLFEDREMIEERL<br>KTYAHLFDDKVMKQLKRRRYTGWGRLSRKLINGIRDKQ | SEQ ID NO: 153 |

-continued

| Description | Sequence | SEQ ID NO: |
|---|---|---|
| | SGKTILDFLKSDGFANRNFMQLIHDDSLTFKEDIQKAQVS GQGDSLHEHIANLAGSPAIKKGILQTVKVVDELVKVMGR HKPENIVIEMARENQTTQKGQKNSRERMKRIEEGIKELGS QILKEHPVENTQLQNEKLYLYYLQNGRDMYVDQELDIN RLSDYDVDAIVPQSFLKDDSIDNKVLTRSDKNRGKSDNV PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG GFSKESILPKRNSDKLIARKKDWDPKKYGGFDSPTVAYS VLVVAKVEKGKSKKLKSVKELLGITIMERSSFEKNPIDFL EAKGYKEVKKDLIIKLPKYSLFELENGRKRMLASAGELQ KGNELALPSKYVNFLYLASHYEKLKGSPEDNEQKQLFVE QHKHYLDEIIEQISEFSKRVILADANLDKVLSAYNKHRDK PIREQAENIIHLFTLTNLGAPAAFKYFDTTIDRKRYTSTKE VLDATLIHQSITGLYETRIDLSQLGGD | |
| Cas9 nickase *Streptococcus pyogenes* Q99ZW2 Cas9 with R863X, wherein X is any alternate amino acid | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRED LLRKQRTFDNGSIPHQIHLGELHAILRRQEDFYPFLKDNR EKIEKILTFRIPYYVGPLARGNSRFAWMTRKSEETITPWNF EEVVDKGASAQSFIERMTNFDKNLPNEKVLPKHSLLYEY FTVYNELTKVKYVTEGMRKPAFLSGEQKKAIVDLLFKTN RKVTVKQLKEDYFKKIECFDSVETSGVEDRFNASLGTYH DLLKIIKDKDFLDNEENEDILEDIVLTLTLFEDREMIEERL KTYAHLFDDKVMKQLKRRRYTGWGRLSRKLINGIRDKQ SGKTILDFLKSDGFANRNFMQLIHDDSLTFKEDIQKAQVS GQGDSLHEHIANLAGSPAIKKGILQTVKVVDELVKVMGR HKPENIVIEMARENQTTQKGQKNSRERMKRIEEGIKELGS QILKEHPVENTQLQNEKLYLYYLQNGRDMYVDQELDIN RLSDYDVDHIVPQSFLKDDSIDNKVLTRSDKNXGKSDNV PSEEVVKKMKNYWRQLLNAKLITQRKFDNLTKAERGGL SELDKAGFIKRQLVETRQITKHVAQILDSRMNTKYDEND KLIREVKVITLKSKLVSDFRKDFQFYKVREINNYHHAHD AYLNAVVGTALIKKYPKLESEFVYGDYKVYDVRKMIAK SEQEIGKATAKYFFYSNIMNFFKTEITLANGEIRKRPLIET NGETGEIVWDKGRDFATVRKVLSMPQVNIVKKTEVQTG GFSKESILPKRNSDKLIARKKDWDPKKYGGFDSPTVAYS VLVVAKVEKGKSKKLKSVKELLGITIMERSSFEKNPIDFL EAKGYKEVKKDLIIKLPKYSLFELENGRKRMLASAGELQ KGNELALPSKYVNFLYLASHYEKLKGSPEDNEQKQLFVE QHKHYLDEIIEQISEFSKRVILADANLDKVLSAYNKHRDK PIREQAENIIHLFTLTNLGAPAAFKYFDTTIDRKRYTSTKE VLDATLIHQSITGLYETRIDLSQLGGD | SEQ ID NO: 154 |
| Cas9 nickase *Streptococcus pyogenes* Q99ZW2 Cas9 with R863A | MDKKYSIGLDIGTNSVGWAVITDEYKVPSKKFKVLGNTD RHSIKKNLIGALLFDSGETAEATRLKRTARRRYTRRKNRI CYLQEIFSNEMAKVDDSFFHRLEESFLVEEDKKHERHPIF GNIVDEVAYHEKYPTIYHLRKKLVDSTDKADLRLIYLAL AHMIKFRGHFLIEGDLNPDNSDVDKLFIQLVQTYNQLFEE NPINASGVDAKAILSARLSKSRRLENLIAQLPGEKKNGLF GNLIALSLGLTPNFKSNFDLAEDAKLQLSKDTYDDDLDN LLAQIGDQYADLFLAAKNLSDAILLSDILRVNTEITKAPLS ASMIKRYDEHHQDLTLLKALVRQQLPEKYKEIFFDQSKN GYAGYIDGGASQEEFYKFIKPILEKMDGTEELLVKLNRED LLRKQRTFDNGSIPHQIHLGELHAILRRQEDFYPFLKDNR EKIEKILTFRIPYYVGPLARGNSRFAWMTRKSEETITPWNF EEVVDKGASAQSFIERMTNFDKNLPNEKVLPKHSLLYEY FTVYNELTKVKYVTEGMRKPAFLSGEQKKAIVDLLFKTN RKVTVKQLKEDYFKKIECFDSVETSGVEDRFNASLGTYH DLLKIIKDKDFLDNEENEDILEDIVLTLTLFEDREMIEERL KTYAHLFDDKVMKQLKRRRYTGWGRLSRKLINGIRDKQ SGKTILDFLKSDGFANRNFMQLIHDDSLTFKEDIQKAQVS GQGDSLHEHIANLAGSPAIKKGILQTVKVVDELVKVMGR HKPENIVIEMARENQTTQKGQKNSRERMKRIEEGIKELGS QILKEHPVENTQLQNEKLYLYYLQNGRDMYVDQELDIN RLSDYDVDHIVPQSFLKDDSIDNKVLTRSDKNAGKSDNV | SEQ ID NO: 155 |

-continued

| Description | Sequence | SEQ ID NO: |
|---|---|---|
| | PSEEVVKKMKNYWRQLLNAKLITQRKFDNLTKAERGGL<br>SELDKAGFIKRQLVETRQITKHVAQILDSRMNTKYDEND<br>KLIREVKVITLKSKLVSDFRKDFQFYKVREINNYHHAHD<br>AYLNAVVGTALIKKYPKLESEFVYGDYKVYDVRKMIAK<br>SEQEIGKATAKYFFYSNIMNFFKTEITLANGEIRKRPLIET<br>NGETGEIVWDKGRDFATVRKVLSMPQVNIVKKTEVQTG<br>GFSKESILPKRNSDKLIARKKDWDPKKYGGFDSPTVAYS<br>VLVVAKVEKGKSKKLKSVKELLGITIMERSSFEKNPIDFL<br>EAKGYKEVKKDLIIKLPKYSLFELENGRKRMLASAGELQ<br>KGNELALPSKYVNFLYLASHYEKLKGSPEDNEQKQLFVE<br>QHKHYLDEIIEQISEFSKRVILADANLDKVLSAYNKHRDK<br>PIREQAENIIHLFTLTNLGAPAAFKYFDTTIDRKRYTSTKE<br>VLDATLIHQSITGLYETRIDLSQLGGD | |

In some embodiments, the N-terminal methionine is removed from a Cas9 nickase, or from any Cas9 variant, ortholog, or equivalent disclosed or contemplated herein. For example, methionine-minus Cas9 nickases include the following sequences, or a variant thereof having an amino acid sequence that has at least 80%, at least 85%, at least 90%, at least 95%, or at least 99% sequence identity thereto.

| Description | Sequence |
|---|---|
| Cas9 nickase<br>(Met minus)<br>*Streptococcus*<br>*pyogenes*<br>Q99ZW2<br>Cas9 with<br>H840X,<br>wherein X is<br>any alternate<br>amino acid | DKKYSIGLDIGTNSVGWAVITDEYKVPSKKFKVLGNTDRHSIKKNLIG<br>ALLFDSGETAEATRLKRTARRRYTRRKNRICYLQEIFSNEMAKVDDSFF<br>HRLEESFLVEEDKKHERHPIFGNIVDEVAYHEKYPTIYHLRKKLVDSTD<br>KADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSL<br>GLTPNFKSNFDLAEDAKLQLSKDTYDDDLDNLLAQIGDQYADLFLAA<br>KNLSDAILLSDILRVNTEITKAPLSASMIKRYDEHHQDLTLLKALVRQQ<br>LPEKYKEIFFDQSKNGYAGYIDGGASQEEFYKFIKPILEKMDGTEELLV<br>KLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQ<br>SFIERMTNFDKNLPNEKVLPKHSLLYEYFTVYNELTKVKYVTEGMRKP<br>AFLSGEQKKAIVDLLFKTNRKVTVKQLKEDYFKKIECFDSVETSGVEDR<br>FNASLGTYHDLLKIIKDKDFLDNEENEDILEDIVLTLTLFEDREMIEERL<br>KTYAHLFDDKVMKQLKRRRYTGWGRLSRKLINGIRDKQSGKTILDFL<br>KSDGFANRNFMQLIHDDSLTFKEDIQKAQVSGQGDSLHEHIANLAGSP<br>AIKKGILQTVKVVDELVKVMGRHKPENIVIEMARENQTTQKGQKNSR<br>ERMKRIEEGIKELGSQILKEHPVENTQLQNEKLYLYYLQNGRDMYVDQ<br>ELDINRLSDYDVDXIVPQSFLKDDSIDNKVLTRSDKNRGKSDNVPSEEV<br>VKKMKNYWRQLLNAKLITQRKFDNLTKAERGGLSELDKAGFIKRQLV<br>ETRQITKHVAQILDSRMNTKYDENDKLIREVKVITLKSKLVSDFRKDFQ<br>FYKVREINNYHHAHDAYLNAVVGTALIKKYPKLESEFVYGDYKVYDV<br>RKMIAKSEQEIGKATAKYFFYSNIMNFFKTEITLANGEIRKRPLIETNGE<br>TGEIVWDKGRDFATVRKVLSMPQVNIVKKTEVQTGGFSKESILPKRNS<br>DKLIARKKDWDPKKYGGFDSPTVAYSVLVVAKVEKGKSKKLKSVKEL<br>LGITIMERSSFEKNPIDFLEAKGYKEVKKDLIIKLPKYSLFELENGRKRM<br>LASAGELQKGNELALPSKYVNFLYLASHYEKLKGSPEDNEQKQLFVEQ<br>HKHYLDEIIEQISEFSKRVILADANLDKVLSAYNKHRDKPIREQAENIIH<br>LFTLTNLGAPAAFKYFDTTIDRKRYTSTKEVLDATLIHQSITGLYETRID<br>LSQLGGD (SEQ ID NO: 156) |
| Cas9 nickase<br>(Met minus)<br>*Streptococcus*<br>*pyogenes*<br>Q99ZW2<br>Cas9 with<br>H840A | DKKYSIGLDIGTNSVGWAVITDEYKVPSKKFKVLGNTDRHSIKKNLIG<br>ALLFDSGETAEATRLKRTARRRYTRRKNRICYLQEIFSNEMAKVDDSFF<br>HRLEESFLVEEDKKHERHPIFGNIVDEVAYHEKYPTIYHLRKKLVDSTD<br>KADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSL<br>GLTPNFKSNFDLAEDAKLQLSKDTYDDDLDNLLAQIGDQYADLFLAA<br>KNLSDAILLSDILRVNTEITKAPLSASMIKRYDEHHQDLTLLKALVRQQ<br>LPEKYKEIFFDQSKNGYAGYIDGGASQEEFYKFIKPILEKMDGTEELLV<br>KLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQ<br>SFIERMTNFDKNLPNEKVLPKHSLLYEYFTVYNELTKVKYVTEGMRKP<br>AFLSGEQKKAIVDLLFKTNRKVTVKQLKEDYFKKIECFDSVETSGVEDR<br>FNASLGTYHDLLKIIKDKDFLDNEENEDILEDIVLTLTLFEDREMIEERL<br>KTYAHLFDDKVMKQLKRRRYTGWGRLSRKLINGIRDKQSGKTILDFL<br>KSDGFANRNFMQLIHDDSLTFKEDIQKAQVSGQGDSLHEHIANLAGSP<br>AIKKGILQTVKVVDELVKVMGRHKPENIVIEMARENQTTQKGQKNSR<br>ERMKRIEEGIKELGSQILKEHPVENTQLQNEKLYLYYLQNGRDMYVDQ<br>ELDINRLSDYDVDAIVPQSFLKDDSIDNKVLTRSDKNRGKSDNVPSEEV<br>VKKMKNYWRQLLNAKLITQRKFDNLTKAERGGLSELDKAGFIKRQLV |

-continued

| Description | Sequence |
|---|---|
| | ETRQITKHVAQILDSRMNTKYDENDKLIREVKVITLKSKLVSDFRKDFQ<br>FYKVREINNYHHAHDAYLNAVVGTALIKKYPKLESEFVYGDYKVYDV<br>RKMIAKSEQEIGKATAKYFFYSNIMNFFKTEITLANGEIRKRPLIETNGE<br>TGEIVWDKGRDFATVRKVLSMPQVNIVKKTEVQTGGFSKESILPKRNS<br>DKLIARKKDWDPKKYGGFDSPTVAYSVLVVAKVEKGKSKKLKSVKEL<br>LGITIMERSSFEKNPIDFLEAKGYKEVKKDLIIKLPKYSLFELENGRKRM<br>LASAGELQKGNELALPSKYVNFLYLASHYEKLKGSPEDNEQKQLFVEQ<br>HKHYLDEIIEQISEFSKRVILADANLDKVLSAYNKHRDKPIREQAENIIH<br>LFTLTNLGAPAAFKYFDTTIDRKRYTSTKEVLDATLIHQSITGLYETRID<br>LSQLGGD (SEQ ID NO: 157) |
| Cas9 nickase (Met minus) *Streptococcus pyogenes* Q99ZW2 Cas9 with R863X, wherein X is any alternate amino acid | DKKYSIGLDIGTNSVGWAVITDEYKVPSKKFKVLGNTDRHSIKKNLIG<br>ALLFDSGETAEATRLKRTARRRYTRRKNRICYLQEIFSNEMAKVDDSFF<br>HRLEESFLVEEDKKHERHPIFGNIVDEVAYHEKYPTIYHLRKKLVDSTD<br>KADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSL<br>GLTPNFKSNFDLAEDAKLQLSKDTYDDDLDNLLAQIGDQYADLFLAA<br>KNLSDAILLSDILRVNTEITKAPLSASMIKRYDEHHQDLTLLKALVRQQ<br>LPEKYKEIFFDQSKNGYAGYIDGGASQEEFYKFIKPILEKMDGTEELLV<br>KLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQ<br>SFIERMTNFDKNLPNEKVLPKHSLLYEYFTVYNELTKVKYVTEGMRKP<br>AFLSGEQKKAIVDLLFKTNRKVTVKQLKEDYFKKIECFDSVETSGVEDR<br>FNASLGTYHDLLKIIKDKDFLDNEENEDILEDIVLTLTLFEDREMIEERL<br>KTYAHLFDDKVMKQLKRRRYTGWGRLSRKLINGIRDKQSGKTILDFL<br>KSDGFANRNFMQLIHDDSLTFKEDIQKAQVSGQGDSLHEHIANLAGSP<br>AIKKGILQTVKVVDELVKVMGRHKPENIVIEMARENQTTQKGQKNSR<br>ERMKRIEEGIKELGSQILKEHPVENTQLQNEKLYLYYLQNGRDMYVDQ<br>ELDINRLSDYDVDHIVPQSFLKDDSIDNKVLTRSDKNXGKSDNVPSEEV<br>VKKMKNYWRQLLNAKLITQRKFDNLTKAERGGLSELDKAGFIKRQLV<br>ETRQITKHVAQILDSRMNTKYDENDKLIREVKVITLKSKLVSDFRKDFQ<br>FYKVREINNYHHAHDAYLNAVVGTALIKKYPKLESEFVYGDYKVYDV<br>RKMIAKSEQEIGKATAKYFFYSNIMNFFKTEITLANGEIRKRPLIETNGE<br>TGEIVWDKGRDFATVRKVLSMPQVNIVKKTEVQTGGFSKESILPKRNS<br>DKLIARKKDWDPKKYGGFDSPTVAYSVLVVAKVEKGKSKKLKSVKEL<br>LGITIMERSSFEKNPIDFLEAKGYKEVKKDLIIKLPKYSLFELENGRKRM<br>LASAGELQKGNELALPSKYVNFLYLASHYEKLKGSPEDNEQKQLFVEQ<br>HKHYLDEIIEQISEFSKRVILADANLDKVLSAYNKHRDKPIREQAENIIH<br>LFTLTNLGAPAAFKYFDTTIDRKRYTSTKEVLDATLIHQSITGLYETRID<br>LSQLGGD (SEQ ID NO: 158) |
| Cas9 nickase (Met minus) *Streptococcus pyogenes* Q99ZW2 Cas9 with R863A | DKKYSIGLDIGTNSVGWAVITDEYKVPSKKFKVLGNTDRHSIKKNLIG<br>ALLFDSGETAEATRLKRTARRRYTRRKNRICYLQEIFSNEMAKVDDSFF<br>HRLEESFLVEEDKKHERHPIFGNIVDEVAYHEKYPTIYHLRKKLVDSTD<br>KADLRLIYLALAHMIKFRGHFLIEGDLNPDNSDVDKLFIQLVQTYNQLF<br>EENPINASGVDAKAILSARLSKSRRLENLIAQLPGEKKNGLFGNLIALSL<br>GLTPNFKSNFDLAEDAKLQLSKDTYDDDLDNLLAQIGDQYADLFLAA<br>KNLSDAILLSDILRVNTEITKAPLSASMIKRYDEHHQDLTLLKALVRQQ<br>LPEKYKEIFFDQSKNGYAGYIDGGASQEEFYKFIKPILEKMDGTEELLV<br>KLNREDLLRKQRTFDNGSIPHQIHLGELHAILRRQEDFYPFLKDNREKIE<br>KILTFRIPYYVGPLARGNSRFAWMTRKSEETITPWNFEEVVDKGASAQ<br>SFIERMTNFDKNLPNEKVLPKHSLLYEYFTVYNELTKVKYVTEGMRKP<br>AFLSGEQKKAIVDLLFKTNRKVTVKQLKEDYFKKIECFDSVETSGVEDR<br>FNASLGTYHDLLKIIKDKDFLDNEENEDILEDIVLTLTLFEDREMIEERL<br>KTYAHLFDDKVMKQLKRRRYTGWGRLSRKLINGIRDKQSGKTILDFL<br>KSDGFANRNFMQLIHDDSLTFKEDIQKAQVSGQGDSLHEHIANLAGSP<br>AIKKGILQTVKVVDELVKVMGRHKPENIVIEMARENQTTQKGQKNSR<br>ERMKRIEEGIKELGSQILKEHPVENTQLQNEKLYLYYLQNGRDMYVDQ<br>ELDINRLSDYDVDHIVPQSFLKDDSIDNKVLTRSDKNAGKSDNVPSEEV<br>VKKMKNYWRQLLNAKLITQRKFDNLTKAERGGLSELDKAGFIKRQLV<br>ETRQITKHVAQILDSRMNTKYDENDKLIREVKVITLKSKLVSDFRKDFQ<br>FYKVREINNYHHAHDAYLNAVVGTALIKKYPKLESEFVYGDYKVYDV<br>RKMIAKSEQEIGKATAKYFFYSNIMNFFKTEITLANGEIRKRPLIETNGE<br>TGEIVWDKGRDFATVRKVLSMPQVNIVKKTEVQTGGFSKESILPKRNS<br>DKLIARKKDWDPKKYGGFDSPTVAYSVLVVAKVEKGKSKKLKSVKEL<br>LGITIMERSSFEKNPIDFLEAKGYKEVKKDLIIKLPKYSLFELENGRKRM<br>LASAGELQKGNELALPSKYVNFLYLASHYEKLKGSPEDNEQKQLFVEQ<br>HKHYLDEIIEQISEFSKRVILADANLDKVLSAYNKHRDKPIREQAENIIH<br>LFTLTNLGAPAAFKYFDTTIDRKRYTSTKEVLDATLIHQSITGLYETRID<br>LSQLGGD (SEQ ID NO: 159) |

Other Cas9 Variants

The napDNAbp domains used in the base editors described herein may also include other Cas9 variants that area at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 protein, including any wild type Cas9, or mutant Cas9 (e.g., a dead Cas9 or Cas9 nickase), or circular permutant Cas9, or other variant of Cas9 disclosed herein or known in the art. In some embodiments, a Cas9 variant may have 1, 2, 3, 4, 5, 6, 7, 8, 9, 10, 11, 12, 13, 14, 15, 16, 17, 18, 19, 20, 21, 22, 21, 24, 25, 26, 27, 28, 29, 30, 31, 32, 33, 34, 35, 36, 37, 38, 39, 40, 41, 42, 43, 44, 45, 46, 47, 48, 49, 50, or more amino acid changes compared to a reference Cas9. In some embodiments, the Cas9 variant comprises a fragment of a reference Cas9 (e.g., a gRNA binding domain or a DNA-cleavage domain), such that the fragment is at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to the corresponding fragment of wild type Cas9. In some embodiments, the fragment is is at least 30%, at least 35%, at least 40%, at least 45%, at least 50%, at least 55%, at least 60%, at least 65%, at least 70%, at least 75%, at least 80%, at least 85%, at least 90%, at least 95% identical, at least 96%, at least 97%, at least 98%, at least 99%, or at least 99.5% of the amino acid length of a corresponding wild type Cas9 (e.g., SEQ ID NO: 141).

In some embodiments, the disclosure also may utilize Cas9 fragments which retain their functions and which are fragments of any herein disclosed Cas9 protein. In some embodiments, the Cas9 fragment is at least 100 amino acids in length. In some embodiments, the fragment is at least 100, 150, 200, 250, 300, 350, 400, 450, 500, 550, 600, 650, 700, 750, 800, 850, 900, 950, 1000, 1050, 1100, 1150, 1200, 1250, or at least 1300 amino acids in length.

In various embodiments, the base editors disclosed herein may comprise one of the Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference Cas9 variants.

Other Cas9 Equivalents

In some embodiments, the base editors described herein can include any Cas9 equivalent. As used herein, the term "Cas9 equivalent" is a broad term that encompasses any napDNAbp protein that serves the same function as Cas9 in the present base editors despite that its amino acid primary sequence and/or its three-dimensional structure may be different and/or unrelated from an evolutionary standpoint. Thus, while Cas9 equivalents include any Cas9 ortholog, homolog, mutant, or variant described or embraced herein that are evolutionarily related, the Cas9 equivalents also embrace proteins that may have evolved through convergent evolution processes to have the same or similar function as Cas9, but which do not necessarily have any similarity with regard to amino acid sequence and/or three dimensional structure. The base editors described here embrace any Cas9 equivalent that would provide the same or similar function as Cas9 despite that the Cas9 equivalent may be based on a protein that arose through convergent evolution.

For example, CasX is a Cas9 equivalent that reportedly has the same function as Cas9 but which evolved through convergent evolution. Thus, the CasX protein described in Liu et al., "CasX enzymes comprises a distinct family of RNA-guided genome editors," Nature, 2019, Vol. 566: 218-223, is contemplated to be used with the base editors described herein. In addition, any variant or modification of CasX is conceivable and within the scope of the present disclosure.

Cas9 is a bacterial enzyme that evolved in a wide variety of species. However, the Cas9 equivalents contemplated herein may also be obtained from archaea, which constitute a domain and kingdom of single-celled prokaryotic microbes different from bacteria.

In some embodiments, Cas9 equivalents may refer to CasX or CasY, which have been described in, for example, Burstein et al., "New CRISPR-Cas systems from uncultivated microbes." Cell Res. 2017 Feb. 21. doi: 10.1038/cr.2017.21, the entire contents of which is hereby incorporated by reference. Using genome-resolved metagenomics, a number of CRISPR-Cas systems were identified, including the first reported Cas9 in the archaeal domain of life. This divergent Cas9 protein was found in little-studied nanoarchaea as part of an active CRISPR-Cas system. In bacteria, two previously unknown systems were discovered, CRISPR-CasX and CRISPR-CasY, which are among the most compact systems yet discovered. In some embodiments, Cas9 refers to CasX, or a variant of CasX. In some embodiments, Cas9 refers to a CasY, or a variant of CasY. It should be appreciated that other RNA-guided DNA binding proteins may be used as a nucleic acid programmable DNA binding protein (napDNAbp), and are within the scope of this disclosure. Also see Liu et al., "CasX enzymes comprises a distinct family of RNA-guided genome editors," Nature, 2019, Vol. 566: 218-223. Any of these Cas9 equivalents are contemplated.

In some embodiments, the Cas9 equivalent comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring CasX or CasY protein. In some embodiments, the napDNAbp is a naturally-occurring CasX or CasY protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a wild-type Cas moiety or any Cas moiety provided herein.

In various embodiments, the nucleic acid programmable DNA binding proteins include, without limitation, Cas9 (e.g., dCas9 and nCas9), CasX, CasY, Cpf1, C2c1, C2c2, C2C3, Argonaute, Cas12a, and Cas12b. One example of a nucleic acid programmable DNA-binding protein that has different PAM specificity than Cas9 is Clustered Regularly Interspaced Short Palindromic Repeats from *Prevotella* and *Francisella* 1 (Cpf1). Similar to Cas9, Cpf1 is also a class 2 CRISPR effector. It has been shown that Cpf1 mediates robust DNA interference with features distinct from Cas9. Cpf1 is a single RNA-guided endonuclease lacking tracrRNA, and it utilizes a T-rich protospacer-adjacent motif (TTN, TTTN, or YTN). Moreover, Cpf1 cleaves DNA via a staggered DNA double-stranded break. Out of 16 Cpf1-family proteins, two enzymes from Acidaminococcus and Lachnospiraceae are shown to have efficient genome-editing activity in human cells. Cpf1 proteins are known in the art and have been described previously, for example Yamano et al., "Crystal structure of Cpf1 in complex with guide RNA and target DNA." Cell (165) 2016, p. 949-962; the entire contents of which is hereby incorporated by reference. The state of the art may also now refer to Cpf1 enzymes as Cas12a.

In still other embodiments, the Cas protein may include any CRISPR associated protein, including but not limited to Cas12a, Cas12b, Cas1, Cas1B, Cas2, Cas3, Cas4, Cas5, Cas6, Cas7, Cas8, Cas9 (sometimes referred to as Csn1 and Csx12), Cas10, Csy1, Csy2, Csy3, Cse1, Cse2, Csc1, Csc2, Csa5, Csn2. Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologs thereof, or modified versions thereof, and preferably comprising a nickase mutation (e.g., a mutation corresponding to the D10A mutation of the wild type SpCas9 polypeptide of SEQ ID NO: 141).

In various other embodiments, the napDNAbp can be any of the following proteins: a Cas9, a Cpf1, a CasX, a CasY, a C2c1, a C2c2, a C2c3, a GeoCas9, a CjCas9, a Cas12a, a Cas12b, a Cas12g, a Cas12h, a Cas12i, a Cas13b, a Cas13c, a Cas13d, a Cas14, a Csn2, an xCas9, an SpCas9-NG, a circularly permuted Cas9, or an Argonaute (Ago), a Cas9-KKH, a SmacCas9, a Spy-macCas9, an SpCas9-VRQR, an SpCas9-NRRH, an SpaCas9-NRTH, an SpCas9-NRCH, or a variant thereof.

In certain embodiments, the base editors contemplated herein can include a Cas9 protein that is of smaller molecular weight than the canonical SpCas9 sequence. In some embodiments, the smaller-sized Cas9 variants may facilitate delivery to cells, e.g., by an expression vector, nanoparticle, or other means of delivery. The canonical SpCas9 protein is 1368 amino acids in length and has a predicted molecular weight of 158 kilodaltons. The term "small-sized Cas9 variant", as used herein, refers to any Cas9 variant—naturally occurring, engineered, or otherwise—that is less than at least 1300 amino acids, or at least less than 1290 amino acids, or than less than 1280 amino acids, or less than 1270 amino acid, or less than 1260 amino acid, or less than 1250 amino acids, or less than 1240 amino acids, or less than 1230 amino acids, or less than 1220 amino acids, or less than 1210 amino acids, or less than 1200 amino acids, or less than 1190 amino acids, or less than 1180 amino acids, or less than 1170 amino acids, or less than 1160 amino acids, or less than 1150 amino acids, or less than 1140 amino acids, or less than 1130 amino acids, or less than 1120 amino acids, or less than 1110 amino acids, or less than 1100 amino acids, or less than 1050 amino acids, or less than 1000 amino acids, or less than 950 amino acids, or less than 900 amino acids, or less than 850 amino acids, or less than 800 amino acids, or less than 750 amino acids, or less than 700 amino acids, or less than 650 amino acids, or less than 600 amino acids, or less than 550 amino acids, or less than 500 amino acids, but at least larger than about 400 amino acids and retaining the required functions of the Cas9 protein.

In various embodiments, the base editors disclosed herein may comprise one of the small-sized Cas9 variants described as follows, or a Cas9 variant thereof having at least about 70% identical, at least about 80% identical, at least about 90% identical, at least about 95% identical, at least about 96% identical, at least about 97% identical, at least about 98% identical, at least about 99% identical, at least about 99.5% identical, or at least about 99.9% identical to any reference small-sized Cas9 protein. Exemplary small-sized Cas9 variants include, but are not limited to, SaCas9 and LbCas12a.

In some embodiments, the base editors described herein may also comprise Cas12a/Cpf1 (dCpf1) variants that may be used as a guide nucleotide sequence-programmable DNA-binding protein domain. The Cas12a/Cpf1 protein has a RuvC-like endonuclease domain that is similar to the RuvC domain of Cas9 but does not have a HNH endonuclease domain, and the N-terminal of Cpf1 does not have the alpha-helical recognition lobe of Cas9. It was shown in Zetsche et al., Cell, 163, 759-771, 2015 (which is incorporated herein by reference) that, the RuvC-like domain of Cpf1 is responsible for cleaving both DNA strands and inactivation of the RuvC-like domain inactivates Cpf1 nuclease activity.

| Description | Sequence | SEQ ID NO: |
|---|---|---|
| SaCas9<br>*Staphylococcus aureus*<br>1053 AA<br>123 kDa | MGKRNYILGLDIGITSVGYGIIDYETRDVIDAGVRLFKEA<br>NVENNEGRRSKRGARRLKRRRRHRIQRVKKLLFDYNLL<br>TDHSELSGINPYEARVKGLSQKLSEEEFSAALLHLAKRR<br>GVHNVNEVEEDTGNELSTKEQISRNSKALEEKYVAELQ<br>LERLKKDGEVRGSINRFKTSDYVKEAKQLLKVQKAYHQ<br>LDQSFIDTYIDLLETRRTYYEGPGEGSPFGWKDIKEWYE<br>MLMGHCTYFPEELRSVKYAYNADLYNALNDLNNLVITR<br>DENEKLEYYEKFQIIENVFKQKKKPTLKQIAKEILVNEED<br>IKGYRVTSTGKPEFTNLKVYHDIKDITARKEIIENAELLD<br>QIAKILTIYQSSEDIQEELTNLNSELTQEEIEQISNLKGYTG<br>THNLSLKAINLILDELWHTNDNQIAIFNRLKLVPKKVDLS<br>QQKEIPTTLVDDFILSPVVKRSFIQSIKVINAIIKKYGLPND<br>IIIELAREKNSKDAQKMINEMQKRNRQTNERIEEIIRTTG<br>KENAKYLIEKIKLHDMQEGKCLYSLEAIPLEDLLNNPFN<br>YEVDHIIPRSVSFDNSFNNKVLVKQEENSKKGNRTPFQY<br>LSSSDSKISYETFKKHILNLAKGKGRISKTKKEYLLEERDI<br>NRFSVQKDFINRNLVDTRYATRGLMNLLRSYFRVNNLD<br>VKVKSINGGFTSFLRRKWKFKKERNKGYKHHAEDALII<br>ANADFIFKEWKKLDKAKKVMENQMFEEKQAESMPEIET<br>EQEYKEIFITPHQIKHIKDFKDYKYSHRVDKKPNRKLIND<br>TLYSTRKDDKGNTLIVNNLNGLYDKDNDKLKKLINKSP<br>EKLLMYHHDPQTYQKLKLIMEQYGDEKNPLYKYYEET<br>GNYLTKYSKKDNGPVIKKIKYYGNKLNAHLDITDDYPN<br>SRNKVVKLSLKPYRFDVYLDNGVYKFVTVKNLDVIKKE<br>NYYEVNSKCYEEAKKLKKISNQAEFIASFYKNDLIKING<br>ELYRVIGVNNDLLNRIEVNMIDITYREYLENMNDKRPPH<br>IIKTIASKTQSIKKYSTDILGNLYEVKSKKHPQIIKK | SEQ ID NO: 160 |
| NmeCas9<br>*N. meningitidis*<br>1083 AA<br>124.5 kDa | MAAFKPNSINYILGLDIGIASVGWAMVEIDEEENPIRLID<br>LGVRVFERAEVPKTGDSLAMARRLARSVRRLTRRRAHR<br>LLRTRRLLKREGVLQAANFDENGLIKSLPNTPWQLRAA<br>ALDRKLTPLEWSAVLLHLIKHRGYLSQRKNEGETADKE<br>LGALLKGVAGNAHALQTGDFRTPAELALNKFEKESGHI<br>RNQRSDYSHTFSRKDLQAELILLFEKQKEFGNPHVSGGL | SEQ ID NO: 161 |

-continued

| Description | Sequence | SEQ ID NO: |
|---|---|---|
| | KEGIETLLMTQRPALSGDAVQKMLGHCTFEPAEPKAAK<br>NTYTAERFIWLTKLNNLRILEQGSERPLTDTERATLMDE<br>PYRKSKLTYAQARKLLGLEDTAFFKGLRYGKDNAEAST<br>LMEMKAYHAISRALEKEGLKDKKSPLNLSPELQDEIGTA<br>FSLFKTDEDITGRLKDRIQPEILEALLKHISFDKFVQISLK<br>ALRRIVPLMEQGKRYDEACAEIYGDHYGKKNTEEKIYLP<br>PIPADEIRNPVVLRALSQARKVINGVVRRYGSPARIHIET<br>AREVGKSFKDRKEIEKRQEENRKDREKAAAKFREYFPN<br>FVGEPKSKDILKLRLYEQQHGKCLYSGKEINLGRLNEKG<br>YVEIDAALPFSRTWDDSFNNKVLVLGSENQNKGNQTPY<br>EYFNGKDNSREWQEFKARVETSRFPRSKKQRILLQKFDE<br>DGFKERNLNDTRYVNRFLCQFVADRMRLTGKGKKRVF<br>ASNGQITNLLRGFWGLRKVRAENDRHHALDAVVVACS<br>TVAMQQKITRFVRYKEMNAFDGKTIDKETGEVLHQKTH<br>FPQPWEFFAQEVMIRVFGKPDGKPEFEEADTLEKLRTLL<br>AEKLSSRPEAVHEYVTPLFVSRAPNRKMSGQGHMETVK<br>SAKRLDEGVSVLRVPLTQLKLKDLEKMVNREREPKLYE<br>ALKARLEAHKDDPAKAFAEPFYKYDKAGNRTQQVKAV<br>RVEQVQKTGVWVRNHNGIADNATMVRVDVFEKGDKY<br>YLVPIYSWQVAKGILPDRAVVQGKDEEDWQLIDDSFNF<br>KFSLHPNDLVEVITKKARMFGYFASCHRGTGNINIRIHDL<br>DHKIGKNGILEGIGVKTALSFQKYQIDELGKEIRPCRLKK<br>RPPVR | |
| CjCas9<br>*C. jejuni*<br>984 AA<br>114.9 kDa | MARILAFDIGISSIGWAFSENDELKDCGVRIFTKVENPKT<br>GESLALPRRLARSARKRLARRKARLNHLKHLIANEFKLN<br>YEDYQSFDESLAKAYKGSLISPYELRFRALNELLSKQDF<br>ARVILHIAKRRGYDDIKNSDDKEKGAILKAIKQNEEKLA<br>NYQSVGEYLYKEYFQKFKENSKEFTNVRNKKESYERCI<br>AQSFLKDELKLIFKKQREFGFSFSKKFEEEVLSVAFYKRA<br>LKDFSHLVGNCSFFTDEKRAPKNSPLAFMFVALTRIINLL<br>NNLKNTEGILYTKDDLNALLNEVLKNGTLTYKQTKKLL<br>GLSDDYEFKGEKGTYFIEFKKYKEFIKALGEHNLSQDDL<br>NEIAKDITLIKDEIKLKKALAKYDLNQNQIDSLSKLEFKD<br>HLNISFKALKLVTPLMLEGKKYDEACNELNLKVAINED<br>KKDFLPAFNETYYKDEVTNPVVLRAIKEYRKVLNALLK<br>KYGKVHKINIELAREVGKNHSQRAKIEKEQNENYKAKK<br>DAELECEKLGLKINSKNILKLRLFKEQKEFCAYSGEKIKI<br>SDLQDEKMLEIDHIYPYSRSFDDSYMNKVLVFTKQNQE<br>KLNQTPFEAFGNDSAKWQKIEVLAKNLPTKKQKRILDK<br>NYKDKEQKNFKDRNLNDTRYIARLVLNYTKDYLDFLPL<br>SDDENTKLNDTQKGSKVHVEAKSGMLTSALRHTWGFS<br>AKDRNNHLHHAIDAVIIAYANNSIVKAFSDFKKEQESNS<br>AELYAKKISELDYKNKRKFFEPFSGFRQKVLDKIDEIFVS<br>KPERKKPSGALHEETFRKEEEFYQSYGGKEGVLKALELG<br>KIRKVNGKIVKNGDMFRVDIFKHKKTNKFYAVPIYTMD<br>FALKVLPNKAVARSKKGEIKDWILMDENYEFCFSLYKD<br>SLILIQTKDMQEPEFVYYNAFTSSTVSLIVSKHDNKFETL<br>SKNQKILFKNANEKEVIAKSIGIQNLKVFEKYIVSALGEV<br>TKAEFRQREDFKK | SEQ ID NO:<br>162 |
| GeoCas9<br>*G.*<br>*stearo-*<br>*thermophilus*<br>1087 AA<br>127 kDa | MRYKIGLDIGITSVGWAVMNLDIPRIEDLGVRIFDRAENP<br>QTGESLALPRRLARSARRRLRRRKHRLERIRRLVIREGIL<br>TKEELDKLFEEKHEIDVWQLRVEALDRKLNNDELARVL<br>LHLAKRRGFKSNRKSERSNKENSTMLKHIEENRAILSSY<br>RTVGEMIVKDPKFALHKRNKGENYTNTIARDDLEREIRL<br>IFSKQREFGNMSCTEEFENEYITIWASQRPVASKDDIEKK<br>VGFCTFEPKEKRAPKATYTFQSFIAWEHINKLRLISPSGA<br>RGLTDEERRLLYEQAFQKNKITYHDIRTLLHLPDDTYFK<br>GIVYDRGESRKQNENIRFLELDAYHQIRKAVDKVYGKG<br>KSSSFLPIDFDTFGYALTLFKDDADIHSYLRNEYEQNGKR<br>MPNLANKVYDNELIEELLNLSFTKFGHLSLKALRSILPY<br>MEQGEVYSSACERAGYTFTGPKKKQKTMLLPNIPPIANP<br>VVMRALTQARKVVNAIIKKYGSPVSIHIELARDLSQTFD<br>ERRKTKKEQDENRKKNETAIRQLMEYGLTLNPTGHDIV<br>KFKLWSEQNGRCAYSLQPIEIERLLEPGYVEVDHVIPYSR<br>SLDDSYTNKVLVLTRENREKGNRIPAEYLGVGTERWQQ<br>FETFVLTNKQFSKKKRDRLLRLHYDENEETEFKNRNLN<br>DTRYISRFFANFIREHLKFAESDDKQKVYTVNGRVTAHL<br>RSRWEFNKNREESDLHHAVDAVIVACTTPSDIAKVTAFY<br>QRREQNKELAKKTEPHFPQPWPHFADELRARLSKHPKE<br>SIKALNLGNYDDQKLESLQPVFVSRMPKRSVTGAAHQE<br>TLRRYVGIDERSGKIQTVVKTKLSEIKLDASGHFPMYGK<br>ESDPRTYEAIRQRLLEHNNDPKKAFQEPLYKPKKNGEPG<br>PVIRTVKIIDTKNQVIPLNDGKTVAYNSNIVRVDVFEKDG<br>KYYCVPVYTMDIMKGILPNKAIEPNKPYSEWKEMTEDY<br>TFRFSLYPNDLIRIELPREKTVKTAAGEEINVKDVFVYYK | SEQ ID NO:<br>163 |

-continued

| Description | Sequence | SEQ ID NO: |
|---|---|---|
| | TIDSANGGLELISHDHRFSLRGVGSRTLKRFEKYQVDVL<br>GNIYKVRGEKRVGLASSAHSKPGKTIRPLQSTRD | |
| LbCas12a<br>*L. bacterium*<br>1228 AA<br>143.9 kDa | MSKLEKFTNCYSLSKTLRFKAIPVGKTQENIDNKRLLVE<br>DEKRAEDYKGVKKLLDRYYLSFINDVLHSIKLKNLNNYI<br>SLFRKKTRTEKENKELENLEINLRKEIAKAFKGNEGYKS<br>LFKKDIIETILPEFLDDKDEIALVNSFNGFTTAFTGFFDNR<br>ENMFSEEAKSTSIAFRCINTENLTRYISNMDIFEKVDAIFDK<br>HEVQEIKEKILNSDYDVEDFFEGEFFNFVLTQEGIDVYNA<br>IIGGFVTESGEKIKGLNEYINLYNQKTKQKLPKFKPLYKQ<br>VLSDRESLSFYGEGYTSDEEVLEVFRNTLNKNSEIFSSIK<br>KLEKLFKNFDEYSSAGIFVKNGPAISTISKDIFGEWNVIR<br>DKWNAEYDDIHLKKKAVVTEKYEDDRRKSFKKIGSFSL<br>EQLQEYADADLSVVEKLKEIIIQKVDEIYKVYGSSEKLFD<br>ADFVLEKSLKKNDAVVAIMKDLLDSVKSFENYIKAFFGE<br>GKETNRDESFYGDFVLAYDILLKVDHIYDAIRNYVTQKP<br>YSKDKFKLYFQNPQFMGGWDKDKETDYRATILRYGSK<br>YYLAIMDKKYAKCLQKIDKDDVNGNYEKINYKLLPGPN<br>KMLPKVFFSKKWMAYYNPSEDIQKIYKNGTFKKGDMF<br>NLNDCHKLIDFFKDSISRYPKWSNAYDFNFSETEKYKDI<br>AGFYREVEEQGYKVSFESASKKEVDKLVEEGKLYMFQI<br>YNKDFSDKSHGTPNLHTMYFKLLFDENNHGQIRLSGGA<br>ELFMRRASLKKEELVVHPANSPIANKNPDNPKKTTTLSY<br>DVYKDKRFSEDQYELHIPIAINKCPKNIFKINTEVRVLLK<br>HDDNPYVIGIDRGERNLLYIVVVDGKGNIVEQYSLNEIIN<br>NFNGIRIKTDYHSLLDKKEKERFEARQNWTSIENIKELKA<br>GYISQVVHKICELVEKYDAVIALEDLNSGFKNSRVKVEK<br>QVYQKFEKMLIDKLNYMVDKKSNPCATGGALKGYQIT<br>NKFESFKSMSTQNGFIFYIPAWLTSKIDPSTGFVNLLKTK<br>YTSIADSKKFISSFDRIMYVPEEDLFEFALDYKNFSRTDA<br>DYIKKWKLYSYGNRIRIFRNPKKNNVFDWEEVCLTSAY<br>KELFNKYGINYQQGDIRALLCEQSDKAFYSSFMALMSL<br>MLQMRNSITGRTDVDFLISPVKNSDGIFYDSRNYEAQEN<br>AILPKNADANGAYNIARKVLWAIGQFKKAEDEKLDKVK<br>IAISNKEWLEYAQTSVKH | SEQ ID NO:<br>164 |
| BhCas12b<br>*B. hisashii*<br>1108 AA<br>130.4kDa | MATRSFILKIEPNEEVKKGLWKTHEVLNHGIAYYMNILK<br>LIRQEAIYEHHEQDPKNPKKVSKAEIQAELWDFVLKMQ<br>KCNSFTHEVDKDEVFNILRELYEELVPSSVEKKGEANQL<br>SNKFLYPLVDPNSQSGKGTASSGRKPRWYNLKIAGDPS<br>WEEEKKKWEEDKKKDPLAKILGKLAEYGLIPLFIPYTDS<br>NEPIVKEIKWMEKSRNQSVRRLDKDMFIQALERFLSWES<br>WNLKVKEEYEKVEKEYKTLEERIKEDIQALKALEQYEK<br>ERQEQLLRDTLNTNEYRLSKRGLRGWREIIQKWLKMDE<br>NEPSEKYLEVFKDYQRKHPREAGDYSVYEFLSKKENHFI<br>WRNHPEYPYLYATFCEIDKKKKDAKQQATFTLADPINH<br>PLWVRFEERSGSNLNKYRILTEQLHTEKLKKKLTVQLDR<br>LIYPTESGGWEEKGKVDIVLLPSRQFYNQIFLDIEEKGKH<br>AFTYKDESIKFPLKGTLGGARVQFDRDHLRRYPHKVESG<br>NVGRIYFNMTVNIEPTESPVSKSLKIHRDDFPKVVNFKPK<br>ELTEWIKDSKGKKLKSGIESLEIGLRVMSIDLGQRQAAA<br>ASIFEVVDQKPDIEGKLFFPIKGTELYAVHRASFNIKLPGE<br>TLVKSREVLRKAREDNLKLMNQKLNFLRNVLHFQQFED<br>ITEREKRVTKWISRQENSDVPLVYQDELIQIRELMYKPY<br>KDWVAFLKQLHKRLEVEIGKEVKHWRKSLSDGRKGLY<br>GISLKNIDEIDRTRKFLLRWSLRPTEPGEVRRLEPGQRFAI<br>DQLNHLNALKEDRLKKMANTIIMHALGYCYDVRKKKW<br>QAKNPACQIILFEDLSNYNPYEERSRFENSKLMKWSRREI<br>PRQVALQGEIYGLQVGEVGAQFSSRFHAKTGSPGIRCSV<br>VTKEKLQDNRFFKNLQREGRLTLDKIAVLKEGDLYPDK<br>GGEKFISLSKDRKCVTTHADINAAQNLQKRFWTRTHGF<br>YKVYCKAYQVDGQTVYIPESKDQKQKIIEEFGEGYFILK<br>DGVYEWVNAGKLKIKKGSSKQSSSELVDSDILKDSFDLA<br>SELKGEKLMLYRDPSGNVFPSDKWMAAGVFFGKLERILI<br>SKLTNQYSISTIEDDSSKQSM | SEQ ID NO:<br>165 |

Additional exemplary Cas9 equivalent protein sequences can include the following:

| Description | Sequence |
|---|---|
| AsCas12a (previously known as Cpf1) *Acidaminococcus* sp. (strain BV3L6) UniProtKB U2UMQ6 | MTQFEGFTNLYQVSKTLRFELIPQGKTLKHIQEQGFIEEDKARNDHYK<br>ELKPIIDRIYKTYADQCLQLVQLDWENLSAAIDSYRKEKTEETRNALIE<br>EQATYRNAIHDYFIGRTDNLTDAINKRHAEIYKGLFKAELFNGKVLKQ<br>LGTVTTTEHENALLRSFDKFTTYFSGFYENRKNVFSAEDISTAIPHRIVQ<br>DNFPKFKENCHIFTRLITAVPSLREHFENVKKAIGIFVSTSIEEVFSFPFY<br>NQLLTQTQIDLYNQLLGGISREAGTEKIKGLNEVLNLAIQKNDETAHII<br>ASLPHRFIPLFKQILSDRNTLSFILEEFKSDEEVIQSFCKYKTLLRNENVL<br>ETAEALFNELNSIDLTHIFISHKKLETISSALCDHWDTLRNALYERRISE<br>LTGKITKSAKEKVQRSLKHEDINLQEIISAAGKELSEAFKQKTSEILSHA<br>HAALDQPLPTTLKKQEEKEILKSQLDSLLGLYHLLDWFAVDESNEVDP<br>EFSARLTGIKLEMEPSLSFYNKARNYATKKPYSVEKFKLNFQMPTLAS<br>GWDVNKEKNNGAILFVKNGLYYLGIMPKQKGRYKALSFEPTEKTSEG<br>FDKMYYDYFPDAAKMIPKCSTQLKAVTAHFQTHTTPILLSNNFIEPLEI<br>TKEIYDLNNPEKEPKKFQTAYAKKTGDQKGYREALCKWIDFTRDFLS<br>KYTKTTSIDLSSLRPSSQYKDLGEYYAELNPLLYHISFQRIAEKEIMDAV<br>ETGKLYLFQIYNKDFAKGHHGKPNLHTLYWTGLFSPENLAKTSIKLNG<br>QAELFYRPKSRMKRMAHRLGEKMLNKKLKDQKTPIPDTLYQELYDY<br>VNHRLSHDLSDEARALLPNVITKEVSHEIIKDRRFTSDKFFFHVPITLNY<br>QAANSPSKFNQRVNAYLKEHPETPIIGIDRGERNLIYITVIDSTGKILEQR<br>SLNTIQQFDYQKKLDNREKERVAARQAWSVVGTIKDLKQGYLSQVIH<br>EIVDLMIHYQAVVVLENLNFGFKSKRTGIAEKAVYQQFEKMLIDKLNC<br>LVLKDYPAEKVGGVLNPYQLTDQFTSFAKMGTQSGFLFYVPAPYTSKI<br>DPLTGFVDPFVWKTIKNHESRKHFLEGFDFLHYDVKTGDFILHFKMNR<br>NLSFQRGLPGFMPAWDIVFEKNETQFDAKGTPFIAGKRIVPVIENHRFT<br>GRYRDLYPANELIALLEEKGIVFRDGSNILPKLLENDDSHAIDTMVALI<br>RSVLQMRNSNAATGEDYINSPVRDLNGVCFDSRFQNPEWPMDADAN<br>GAYHIALKGQLLLNHLKESKDLKLQNGISNQDWLAYIQELRN (SEQ ID NO: 166) |
| AsCas12a nickase (e.g., R1226A) | MTQFEGFTNLYQVSKTLRFELIPQGKTLKHIQEQGFIEEDKARNDHYK<br>ELKPIIDRIYKTYADQCLQLVQLDWENLSAAIDSYRKEKTEETRNALIE<br>EQATYRNAIHDYFIGRTDNLTDAINKRHAEIYKGLFKAELFNGKVLKQ<br>LGTVTTTEHENALLRSFDKFTTYFSGFYENRKNVFSAEDISTAIPHRIVQ<br>DNFPKFKENCHIFTRLITAVPSLREHFENVKKAIGIFVSTSIEEVFSFPFY<br>NQLLTQTQIDLYNQLLGGISREAGTEKIKGLNEVLNLAIQKNDETAHII<br>ASLPHRFIPLFKQILSDRNTLSFILEEFKSDEEVIQSFCKYKTLLRNENVL<br>ETAEALFNELNSIDLTHIFISHKKLETISSALCDHWDTLRNALYERRISE<br>LTGKITKSAKEKVQRSLKHEDINLQEIISAAGKELSEAFKQKTSEILSHA<br>HAALDQPLPTTLKKQEEKEILKSQLDSLLGLYHLLDWFAVDESNEVDP<br>EFSARLTGIKLEMEPSLSFYNKARNYATKKPYSVEKFKLNFQMPTLAS<br>GWDVNKEKNNGAILFVKNGLYYLGIMPKQKGRYKALSFEPTEKTSEG<br>FDKMYYDYFPDAAKMIPKCSTQLKAVTAHFQTHTTPILLSNNFIEPLEI<br>TKEIYDLNNPEKEPKKFQTAYAKKTGDQKGYREALCKWIDFTRDFLS<br>KYTKTTSIDLSSLRPSSQYKDLGEYYAELNPLLYHISFQRIAEKEIMDAV<br>ETGKLYLFQIYNKDFAKGHHGKPNLHTLYWTGLFSPENLAKTSIKLNG<br>QAELFYRPKSRMKRMAHRLGEKMLNKKLKDQKTPIPDTLYQELYDY<br>VNHRLSHDLSDEARALLPNVITKEVSHEIIKDRRFTSDKFFFHVPITLNY<br>QAANSPSKFNQRVNAYLKEHPETPIIGIDRGERNLIYITVIDSTGKILEQR<br>SLNTIQQFDYQKKLDNREKERVAARQAWSVVGTIKDLKQGYLSQVIH<br>EIVDLMIHYQAVVVLENLNFGFKSKRTGIAEKAVYQQFEKMLIDKLNC<br>LVLKDYPAEKVGGVLNPYQLTDQFTSFAKMGTQSGFLFYVPAPYTSKI<br>DPLTGFVDPFVWKTIKNHESRKHFLEGFDFLHYDVKTGDFILHFKMNR<br>NLSFQRGLPGFMPAWDIVFEKNETQFDAKGTPFIAGKRIVPVIENHRFT<br>GRYRDLYPANELIALLEEKGIVFRDGSNILPKLLENDDSHAIDTMVALI<br>RSVLQMANSNAATGEDYINSPVRDLNGVCFDSRFQNPEWPMDADAN<br>GAYHIALKGQLLLNHLKESKDLKLQNGISNQDWLAYIQELRN (SEQ ID NO: 167) |
| LbCas12a (previously known as Cpf1) *Lachnospiraceae bacterium* GAM79 Ref Seq. WP_119623382.1 | MNYKTGLEDFIGKESLSKTLRNALIPTESTKIHMEEMGVIRDDELRAEK<br>QQELKEIMDDYYRTFIEEKLGQIQGIQWNSLFQKMEETMEDISVRKDL<br>DKIQNEKRKEICCYFTSDKRFKDLFNAKLITDILPNFIKDNKEYTEEEKA<br>EKEQTRVLFQRFATAFTNYFNQRRNNFSEDNISTAISFRIVNENSEIHLQ<br>NMRAFQRIEQQYPEEVCGMEEEYKDMLQEWQMKHIYSVDFYDRELT<br>QPGIEYYNGICGKINEHMNQFCQKNRINKNDFRMKKLHKQILCKKSSY<br>YEIPFRFESDQEVYDALNEFIKTMKKKEIIRRCVHLGQECDDYDLGKIY<br>ISSNKYEQISNALYGSWDTIRKCIKEEYMDALPGKGEKKEEKAEAAAK<br>KEEYRSIADIDKIISLYGSEMDRTISAKKCITEICDMAGQISIDPLVCNSDI<br>KLLQNKEKTTEIKTILDSFLHVYQWGQTFIVSDIIEKDSYFYSELEDVLE<br>DFEGITTLYNHVRSYVTQKPYSTVKFKLHFGSPTLANGWSQSKEYDNN<br>AILLMRDQKFYLGIFNVRNKPDKQIIKGHEKEEKGDYKKMIYNLLPGP<br>SKMLPKVFITSRSGQETYKPSKHILDGYNEKRHIKSSPKFDLGYCWDLI<br>DYYKECIHKHPDWKNYDFHFSDTKDYEDISGFYREVEMQGYQIKWTY<br>ISADEIQKLDEKGQIFLFQIYNKDFSVHSTGKDNLHTMYLKNLFSEENL<br>KDIVLKLNGEAELFFRKASIKTPIVHKKGSVLVNRSYTQTVGNKEIRVS<br>IPEEYYTEIYNYLNHIGKGKLSSEAQRYLDEGKIKSFTATKDIVKNYRY<br>CCDHYFLHLPITINFKAKSDVAVNERTLAYIAKKEDIHIIGIDRGERNLL |

-continued

| Description | Sequence |
|---|---|
| | YISVVDVHGNIREQRSFNIVNGYDYQQKLKDREKSRDAARKNWEEIE KIKELKEGYLSMVIHYIAQLVVKYNAVVAMEDLNYGFKTGRFKVERQ VYQKFETMLIEKLHYLVFKDREVCEEGGVLRGYQLTYIPESLKKVGKQ CGFIFYVPAGYTSKIDPTTGFVNLFSFKNLTNRESRQDFVGKFDEIRYD RDKKMFEFSFDYNNYIKKGTILASTKWKVYTNGTRLKRIVVNGKYTS QSMEVELTDAMEKMLQRAGIEYHDGKDLKGQIVEKGIEAEIIDIFRLTV QMRNSRSESEDREYDRLISPVLNDKGEFFDTATADKTLPQDADANGA YCIALKGLYEVKQIKENWKENEQFPRNKLVQDNKTWFDFMQKKRYL (SEQ ID NO: 168) |
| PcCas12a- previously known at Cpf1 *Prevotella copri* Ref Seq. WP_119227726.1 | MAKNFEDFKRLYSLSKTLRFEAKPIGATLDNIVKSGLLDEDEHRAASY VKVKKLIDEYHKVFIDRVLDDGCLPLENKGNNNSLAEYYESYVSRAQ DEDAKKKFKEIQQNLRSVIAKKLTEDKAYANLFGNKLIESYKDKEDKK KIIDSDLIQFINTAESTQLDSMSQDEAKELVKEFWGFVTYFYGFFDNRK NMYTAEEKSTGIAYRLVNENLPKFIDNIEAFNRAITRPEIQENMGVLYS DFSEYLNVESIQEMFQLDYYNMLLTQKQIDVYNAIIGGKTDDEHDVKI KGINEYINLYNQQHKDDKLPKLKALFKQILSDRNAISWLPEEFNSDQE VLNAIKDCYERLAENVLGDKVLKSLLGSLADYSLDGIFIRNDLQLTDIS QKMFGNWGVIQNAIMQNIKRVAPARKHKESEEDYEKRIAGIFKKADSF SISYINDCLNEADPNNAYFVENYFATFGAVNTPTMQRENLFALVQNAY TEVAALLHSDYPTVKHLAQDKANVSKIKALLDAIKSLQHFVKPLLGKG DESDKDERFYGELASLWAELDTVTPLYNMIRNYMTRKPYSQKKIKLN FENPQLLGGWDANKEKDYATIILRRNGLYYLAIMDKDSRKLLGKAMP SDGECYEKMVYKFFKDVTTMIPKCSTQLKDVQAYFKVNTDDYVLNS KAFNKPLTITKEVFDLNNVLYGKYKKFQKGYLTATGDNVGYTHAVN VWIKFCMDFLNSYDSTCIYDFSSLKPESYLSLDAFYQDANLLLYKLSFA RASVSYINQLVEEGKMYLFQIYNKDFSEYSKGTPNMHTLYWKALFDE RNLADVVYKLNGQAEMFYRKKSIENTHPTHPANHPILNKNKDNKKKE SLFDYDLIKDRRYTVDKFMFHVPITMNFKSVGSENINQDVKAYLRHAD DMHIIGIDRGERHLLYLVVIDLQGNIKEQYSLNEIVNEYNGNTYHTNY HDLLDVREEERLKARQSWQTIENIKELKEGYLSQVIHKITQLMVRYHA IVVLEDLSKGFMRSRQKVEKQVYQKFEKMLIDKLNYLVDKKTDVSTP GGLLNAYQLTCKSDSSQKLGKQSGFLFYIPAWNTSKIDPVTGFVNLLD THSLNSKEKIKAFFSKFDAIRYNKDKKWFEFNLDYDKFGKKAEDTRTK WTLCTRGMRIDTFRNKEKNSIQWDNQEVDLTTEMKSLLEHYYIDIHGN LKDAISAQTDKAFFTGLLHILKLTLQMRNSITGTETDYLVSPVADENGI FYDSRSCGNQLPENADANGAYNIARKGLMLIEQIKNAEDLNNVKFDIS NKAWLNFAQQKPYKNG (SEQ ID NO: 169) |
| ErCas12a - previously known at Cpf1 *Eubacterium rectale* Ref Seq. WP_119223642.1 | MFSAKLISDILPEFVIHNNNYSASEKEEKTQVIKLFSRFATSFKDYFKNR ANCFSANDISSSSCHRIVNDNAEIFFSNALVYRRIVKNLSNDDINKISGD MKDSLKEMSLEEIYSYEKYGEFITQEGISFYNDICGKVNLFMNLYCQK NKENKNLYKLRKLHKQILCIADTSYEVPYKFESDEEVYQSVNGFLDNI SSKHIVERLRKIGENYNGYNLDKIYIVSKFYESVSQKTYRDWETINTAL EIHYNNILPGNGKSKADKVKKAVKNDLQKSITEINELVSNYKLCPDDNI KAETYIHEISHILNNFEAQELKYNPEIHLVESELKASELKNVLDVIMNAF HWCSVFMTEELVDKDNNFYAELEEIYDEIYPVISLYNLVRNYVTQKPY STKKIKLNFGIPTLADGWSKSKEYSNNAIILMRDNLYYLGIFNAKNKPD KKIIEGNTSENKGDYKKMIYNLLPGPNKMIPKVFLSSKTGVETYKPSAY ILEGYKQNKHLKSSKDFDITFCHDLIDYFKNCIAIHPEWKNFGFDFSDTS TYEDISGFYREVELQGYKIDWTYISEKDIDLLQEKGQLYLFQIYNKDFS KKSSGNDNLHTMYLKNLFSEENLKDIVLKLNGEAEIFFRKSSIKNPIIHK KGSILVNRTYEAEEKDQFGNIQIVRKTIPENIYQELYKYFNDKSDKELS DEAAKLKNVVGHHEAATNIVKDYRYTYDKYFLHMPITINFKANKTSFI NDRILQYIAKEKDLHVIGIDRGERNLIYVSVIDTCGNIVEQKSFNIVNGY DYQIKLKQQEGARQIARKEWKEIGKIKEIKEGYLSLVIHEISKMVIKYN AIIAMEDLSYGFKKGRFKVERQVYQKFETMLINKLNYLVFKDISITENG GLLKGYQLTYIPDKLKNVGHQCGCIFYVPAAYTSKIDPTTGFVNIFKFK DLTVDAKREFIKKFDSIRYDSDKNLFCFTFDYNNFITQNTVMSKSSWSV YTYGVRIKRRFVNGRFSNESDTIDITKDMEKTLEMTDINWRDGHDLRQ DIIDYEIVQHIFEIFKLTVQMRNSLSELEDRDYDRLISPVLNENNIFYDSA KAGDALPKDADANGAYCIALKGLYEIKQITENWKEDGKFSRDKLKISN KDWFDFIQNKRYL (SEQ ID NO: 170) |
| CsCas12a - previously known at Cpf1 *Clostridium* sp. AF34-10BH Ref Seq. WP_118538418.1 | MNYKTGLEDFIGKESLSKTLRNALIPTESTKIHMEEMGVIRDDELRAEK QQELKEIMDDYYRAFIEEKLGQIQGIQWNSLFQKMEETMEDISVRKDL DKIQNEKRKEICCYFTSDKRFKDLFNAKLITDILPNFIKDNKEYTEEEKA EKEQTRVLFQRFATAFTNYFNQRRNNFSEDNISTAISFRIVNENSEIHLQ NMRAFQRIEQQYPEEVCGMEEEYKDMLQEWQMKHIYLVDFYDRVLT QPGIEYYNGICGKINEHMNQFCQKNRINKNDFRMKKLHKQILCKKSSY YEIPFRFESDQEVYDALNEFIKTMKEKEIICRCVHLGQKCDDYDLGKIY ISSNKYEQISNALYGSWDTIRKCIKEEYMDALPGKGEKKEEKAEAAAK KEEYRSIADIDKIISLYGSEMDRTISAKKCITEICDMAGQISTDPLVCNSD IKLLQNKEKTTEIKTILDSFLHVYQWGQTFIVSDIIEKDSYFYSELEDVL EDFEGITTLYNHVRSYVTQKPYSTVKFKLHFGSPTLANGWSQSKEYDN NAILLMRDQKFYLGIFNVRNKPDKQIIKGHEKEEKGDYKKMIYNLLPG PSKMLPKVFITSRSGQETYKPSKHILDGYNEKRHIKSSPKFDLGYCWDL |

-continued

| Description | Sequence |
|---|---|
| | IDYYKECIHKHPDWKNYDFHFSDTKDYEDISGFYREVEMQGYQIKWT YISADEIQKLDEKGQIFLFQIYNKDFSVHSTGKDNLHTMYLKNLFSEEN LKDIVLKLNGEAELFFRKASIKTPVVHKKGSVLVNRSYTQTVGDKEIR VSIPEEYYTEIYNYLNHIGRGKLSTEAQRYLEERKIKSFTATKDIVKNYR YCCDHYFLHLPITINFKAKSDIAVNERTLAYIAKKEDIHIIGIDRGERNLL YISVVDVHGNIREQRSFNIVNGYDYQQKLKDREKSRDAARKNWEEIE KIKELKEGYLSMVIHYIAQLVVKYNAVVAMEDLNYGFKTGRFKVERQ VYQKFETMLIEKLHYLVFKDREVCEEGGVLRGYQLTYIPESLKKVGKQ CGFIFYVPAGYTSKIDPTTGFVNLFSFKNLTNRESRQDFVGKFDEIRYD RDKKMFEFSFDYNNYIKKGTMLASTKWKVYTNGTRLKRIVVNGKYTS QSMEVELTDAMEKMLQRAGIEYHDGKDLKGQIVEKGIEAEIIDIFRLTV QMRNSRSESEDREYDRLISPVLNDKGEFFDTATADKTLPQDADANGA YCIALKGLYEVKQIKENWKENEQFPRNKLVQDNKTWFDFMQKKRYL (SEQ ID NO: 171) |
| BhCas12b *Bacillus hisashii* Ref Seq. WP_095142515.1 | MATRSFILKIEPNEEVKKGLWKTHEVLNHGIAYYMNILKLIRQEAIYEH HEQDPKNPKKVSKAEIQAELWDFVLKMQKCNSFTHEVDKDEVFNILR ELYEELVPSSVEKKGEANQLSNKFLYPLVDPNSQSGKGTASSGRKPRW YNLKIAGDPSWEEEKKKWEEDKKKDPLAKILGKLAEYGLIPLFIPYTDS NEPIVKEIKWMEKSRNQSVRRLDKDMFIQALERFLSWESWNLKVKEE YEKVEKEYKTLEERIKEDIQALKALEQYEKERQEQLLRDTLNTNEYRL SKRGLRGWREIIQKWLKMDENEPSEKYLEVFKDYQRKHPREAGDYSV YEFLSKKENHFIWRNHPEYPYLYATFCEIDKKKKDAKQQATFTLADPI NHPLWVRFEERSGSNLNKYRILTEQLHTEKLKKKLTVQLDRLIYPTES GGWEEKGKVDIVLLPSRQFYNQIFLDIEEKGKHAFTYKDESIKFPLKGT LGGARVQFDRDHLRRYPHKVESGNVGRIYFNMTVNIEPTESPVSKSLK IHRDDFPKVVNFKPKELTEWIKDSKGKKLKSGIESLEIGLRVMSIDLGQ RQAAAASIFEVVDQKPDIEGKLFFPIKGTELYAVHRASFNIKLPGETLV KSREVLRKAREDNLKLMNQKLNFLRNVLHFQQFEDITEREKRVTKWIS RQENSDVPLVYQDELIQIRELMYKPYKDWVAFLKQLHKRLEVEIGKE VKHWRKSLSDGRKGLYGISLKNIDEIDRTRKFLLRWSLRPTEPGEVRR LEPGQRFAIDQLNHLNALKEDRLKKMANTIIMHALGYCYDVRKKKW QAKNPACQIILFEDLSNYNPYEERSRFENSKLMKWSRREIPRQVALQGE IYGLQVGEVGAQFSSRFHAKTGSPGIRCSVVTKEKLQDNRFFKNLQRE GRLTLDKIAVLKEGDLYPDKGGEKFISLSKDRKCVTTHADINAAQNLQ KRFWTRTHGFYKVYCKAYQVDGQTVYIPESKDQKQKIIEEFGEGYFIL KDGVYEWVNAGKLKIKKGSSKQSSSELVDSDILKDSFDLASELKGEKL MLYRDPSGNVFPSDKWMAAGVFFGKLERILISKLTNQYSISTIEDDSSK QSM (SEQ ID NO: 172) |
| ThCas12b *Thermomonas hydrothermalis* Ref Seq. WP_072754838 | MSEKTTQRAYTLRLNRASGECAVCQNNSCDCWHDALWATHKAVNR GAKAFGDWLLTLRGGLCHTLVEMEVPAKGNNPPQRPTDQERRDRRV LLALSWLSVEDEHGAPKEFIVATGRDSADDRAKKVEEKLREILEKRDF QEHEIDAWLQDCGPSLKAHIREDAVWVNRRALFDAAVERIKTLTWEE AWDFLEPFFGTQYFAGIGDGKDKDDAEGPARQGEKAKDLVQKAGQW LSARFGIGTGADFMSMAEAYEKIAKWASQAQNGDNGKATIEKLACAL RPSEPPTLDTVLKCISGPGHKSATREYLKTLDKKSTVTQEDLNQLRKLA DEDARNCRKKVGKKGKKPWADEVLKDVENSCELTYLQDNSPARHRE FSVMLDHAARRVSMAHSWIKKAEQRRRQFESDAQKLKNLQERAPSA VEWLDRFCESRSMTTGANTGSGYRIRKRAIEGWSYVVQAWAEASCDT EDKRIAAARKVQADPEIEKFGDIQLFEALAADEAICVWRDQEGTQNPSI LIDYVTGKTAEHNQKRFKVPAYRHPDELRHPVFCDFGNSRWSIQFAIH KEIRDRDKGAKQDTRQLQNRHGLKMRLWNGRSMTDVNLHWSSKRL TADLALDQNPNPNPTEVTRADRLGRAASSAFDHVKIKNVFNEKEWNG RLQAPRAELDRIAKLEEQGKTEQAEKLRKRLRWYVSFSPCLSPSGPFIV YAGQHNIQPKRSGQYAPHAQANKGRARLAQLILSRLPDLRILSVDLGH RFAAACAVWETLSSDAFRREIQGLNVLAGGSGEGDLFLHVEMTGDDG KRRTVVYRRIGPDQLLDNTPHPAPWARLDRQFLIKLQGEDEGVREASN EELWTVHKLEVEVGRTVPLIDRMVRSGFGKTEKQKERLKKLRELGWI SAMPNEPSAETDEKEGEIRSISRSVDELMSSALGTLRLALKRHGNRARI AFAMTADYKPMPGGQKYYFHEAKEASKNDDETKRRDNQIEFLQDAL SLWHDLFSSPDWEDNEAKKLWQNHIATLPNYQTPEEISAELKRVERNK KRKENRDKLRTAAKALAENDQLRQHLHDTWKERWESDDQQWKERL RSLKDWIFPRGKAEDNPSIRHVGGLSITRINTISGLYQILKAFKMRPEPD DLRKNIPQKGDDELENFNRRLLEARDRLREQRVKQLASRIIEAALGVG RIKIPKNGKLPKRPRTTVDTPCHAVVIESLKTYRPDDLRTRRENRQLMQ WSSAKVRKYLKEGCELYGLHFLEVPANYTSRQCSRTGLPGIRCDDVPT GDFLKAPWWRRAINTAREKNGGDAKDRFLVDLYDHLNNLQSKGEAL PATVRVPRQGGNLFIAGAQLDDTNKERRAIQADLNAAANIGLRALLDP DWRGRWWYVPCKDGTSEPALDRIEGSTAFNDVRSLPTGDNSSRRAPR EIENLWRDPSGDSLESGTWSPTRAYWDTVQSRVIELLRRHAGLPTS (SEQ ID NO: 173) |
| LsCas12b *Laceyella sacchari* WP_132221894.1 | MSIRSFKLKLKTKSGVNAEQLRRGLWRTHQLINDGIAYYMNWLVLLR QEDLFIRNKETNEIEKRSKEEIQAVLLERVHKQQQRNQWSGEVDEQTL LQALRQLYEEIVPSVIGKSGNASLKARFFLGPLVDPNNKTTKDVSKSGP TPKWKKMKDAGDPNWVQEYEKYMAERQTLVRLEEMGLIPLFPMYTD |

-continued

| Description | Sequence |
|---|---|
| | EVGDIHWLPQASGYTRTWDRDMFQQAIERLLSWESWNRRVRERRAQ<br>FEKKTHDFASRFSESDVQWMNKLREYEAQQEKSLEENAFAPNEPYAL<br>TKKALRGWERVYHSWMRLDSAASEEAYWQEVATCQTAMRGEFGDP<br>AIYQFLAQKENHDIWRGYPERVIDFAELNHLQRELRRAKEDATFTLPD<br>SVDHPLWVRYEAPGGTNIHGYDLVQDTKRNLTLILDKFILPDENGSWH<br>EVKKVPFSLAKSKQFHRQVWLQEEQKQKKREVVFYDYSTNLPHLGTL<br>AGAKLQWDRNFLNKRTQQQIEETGEIGKVFFNISVDVRPAVEVKNGRL<br>QNGLGKALTVLTHPDGTKIVTGWKAEQLEKWVGESGRVSSLGLDSLS<br>EGLRVMSIDLGQRTSATVSVFEITKEAPDNPYKFFYQLEGTEMFAVHQ<br>RSFLLALPGENPPQKIKQMREIRWKERNRIKQQVDQLSAILRLHKKVN<br>EDERIQAIDKLLQKVASWQLNEEIATAWNQALSQLYSKAKENDLQWN<br>QAIKNAHHQLEPVVGKQISLWRKDLSTGRQGIAGLSLWSIEELEATKK<br>LLTRWSKRSREPGVVKRIERFETFAKQIQHHINQVKENRLKQLANLIV<br>MTALGYKYDQEQKKWIEVYPACQVVLFENLRSYRFSFERSRRENKKL<br>MEWSHRSIPKLVQMQGELFGLQVADVYAAYSSRYHGRTGAPGIRCHA<br>LTEADLRNETNIIHELIEAGFIKEEHRPYLQQGDLVPWSGGELFATLQK<br>PYDNPRILTLHADINAAQNIQKRFWHPSMWFRVNCESVMEGEIVTYVP<br>KNKTVHKKQGKTFRFVKVEGSDVYEWAKWSKNRNKNTFSSITERKPP<br>SSMILFRDPSGTFFKEQEWVEQKTFWGKVQSMIQAYMKKTIVQRMEE<br>(SEQ ID NO: 174) |
| DtCas12b<br>*Dsulfonatronum thiodismutans*<br>WP_031386437 | MVLGRKDDTAELRRALWTTHEHVNLAVAEVERVLLRCRGRSYWTLD<br>RRGDPVHVPESQVAEDALAMAREAQRRNGWPVVGEDEEILLALRYL<br>YEQIVPSCLLDDLGKPLKGDAQKIGTNYAGPLFDSDTCRRDEGKDVAC<br>CGPFHEVAGKYLGALPEWATPISKQEFDGKDASHLRFKATGGDDAFF<br>RVSIEKANAWYEDPANQDALKNKAYNKDDWKKEKDKGISSWAVKYI<br>QKQLQLGQDPRTEVRRKLWLELGLLPLPFIPVFDKTMVGNLWNRLAVR<br>LALAHLLSWESWNHRAVQDQALARAKRDELAALFLGMEDGFAGLRE<br>YELRRNESIKQHAFEPVDRPYVVSGRALRSWTRVREEWLRHGDTQES<br>RKNICNRLQDRLRGKFGDPDVFHWLAEDGQEALWKERDCVTSFSLLN<br>DADGLLEKRKGYALMTFADARLHPRWAMYEAPGGSNLRTYQIRKTE<br>NGLWADVVLLSPRNESAAVEEKTFNVRLAPSGQLSNVSFDQIQKGSK<br>MVGRCRYQSANQQFEGLLGGAEILFDRKRIANEQHGATDLASKPGHV<br>WFKLTLDVRPQAPQGWLDGKGRPALPPEAKHFKTALSNKSKFADQVR<br>PGLRVLSVDLGVRSFAACSVFELVRGGPDQGTYFPAADGRTVDDPEK<br>LWAKHERSFKITLPGENPSRKEEIARRAAMEELRSLNGDIRRLKAILRL<br>SVLQEDDPRTEHLRLFMEAIVDDPAKSALNAELFKGFGDDRFRSTPDL<br>WKQHCHFFHDKAEKVVAERFSRWRTETRPKSSSWQDWRERRGYAGG<br>KSYWAVTYLEAVRGLILRWNMRGRTYGEVNRQDKKQFGTVASALLH<br>HINQLKEDRIKTGADMIIQAARGFVPRKNGAGWVQVHEPCRLILFEDL<br>ARYRFRTDRSRRENSRLMRWSHREIVNEVGMQGELYGLHVDTTEAGF<br>SSRYLASSGAPGVRCRHLVEEDFHDGLPGMHLVGELDWLLPKDKDRT<br>ANEARRLLGGMVRPGMLVPWDGGELFATLNAASQLHVIHADINAAQ<br>NLQRRFWGRCGEAIRIVCNQLSVDGSTRYEMAKAPKARLLGALQQLK<br>NGDAPFHLTSIPNSQKPENSYVMTPTNAGKKYRAGPGEKSSGEEDELA<br>LDIVEQAEELAQGRKTFFRDPSGVFFAPDRWLPSEIYWSRIRRRIWQVT<br>LERNSSGRQERAEMDEMPY (SEQ ID NO: 175) |

napDNAbps That Recognize Non-Canonical PAM Sequences

In some embodiments, the napDNAbp is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 2016 July; 34(7):768-73. PubMed PMID: 27136078; Swarts et al., *Nature.* 507(7491) (2014): 258-61; and Swarts et al., *Nucleic Acids Res.* 43(10) (2015): 5120-9, each of which is incorporated herein by reference.

In some embodiments, the disclosure provides napDNAbp domains that comprise SpCas9 variants that recognize and work best with NRRH, NRCH, and NRTH PAMs. See PCT Application No. PCT/US2019/47996, incorporated by reference herein. In some embodiments, the disclosed base editors comprise a napDNAbp domain selected from SpCas9-NRRH, SpCas9-NRTH, and SpCas9-NRCH.

In some embodiments, the disclosed base editors comprise a napDNAbp domain that has a sequence that is at least 90%, at least 95%, at least 98%, or at least 99% identical to SpCas9-NRRH. In some embodiments, the disclosed base editors comprise a napDNAbp domain that comprises SpCas9-NRRH. The SpCas9-NRRH has an amino acid sequence as presented in SEQ ID NO: 176 (underligned residues are mutated relative to SpCas9, as set forth in SEQ ID NO: 141):

(SEQ ID NO: 176)

MDKYSIGLDIGTNSVGWAVITDEYKVPSKKFKVLGNTDRHSIKKNLIGALL

FDSGETAEATRLKRTARRRYTRRKNRICYLQEIFSNEMAKVDDSFFHRLEE

SFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASG

-continued

VDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILR

VNTEITKAPLSASMVKRYDEHHQDLTLLKALVRQQLPEKYKEIFFDQSKNG

YAGYIDGGASQEEFYKFIKPILEKMDGTEELLVKLNREDLLRKQRTFDNGI

IPHQIHLGELHAILRRQGDFYPFLKDNREKIEKILTFRIPYYVGPLARGNS

RFAWMTRKSEETITPWNFEEVVDKGASAQSFIERMTNFDKNLPNEKVLPKH

SLLYEYFTVYNELTKVKYVTEGMRKPAFLSGEQKKAIVDLLFKTNRKVTVK

QLKEDYFKKIECFDSVEISGVEDRFNASLGTYHDLLKIIKDKDFLDNEENE

DILEDIVLTLTLFEDREMIEERLKTYAHLFDDKVMKQLKRLRYTGWGRLSR

KLINGIRDKQSGKTILDFLKSDGFANRNFMQLIHDDSLTFKEDIQKAQVSG

QGDSLHEHIANLAGSPAIKKGILQTVKVVDELVKVMGGHKPENIVIEMARE

NQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKGNSDKLIARK

KDWDPKKYGGFNSPTAAYSVLVVAKVEKGKSKKLKSVKELLGITIMERSSF

EKNPIGFLEAKGYKEVKKDLIIKLPKYSLFELENGRKRMLASAGVLHKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGVPAAFKYF

DTTIDKKRYTSTKEVLDATLIHQSITGLYETRIDLSQLGGD.

In some embodiments, the disclosed base editors comprise a napDNAbp domain that has a sequence that is at least 90%, at least 95%, at least 98%, or at least 99% identical to SpCas9-NRCH. In some embodiments, the disclosed base editors comprise a napDNAbp domain that comprises SpCas9-NRCH. The SpCas9-NRCH has an amino acid sequence as presented in SEQ ID NO: 177 (underlined residues are mutated relative to SpCas9):

(SEQ ID NO: 177)

MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMVKRYDEHHQDLTLLKALVRQQLPEKYKEIFFDQSKN

GYAGYIDGGASQEEFYKFIKPILEKMDGTEELLVKLNREDLLRKQRTFDNG

IIPHQIHLGELHAILRRQGDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

-continued

KQLKEDYFKKIECFDSVEISGVEDRFNASLGTYHDLLKIIKDKDFLDNEEN

EDILEDIVLTLTLFEDREMIEERLKTYAHLFDDKVMKQLKRLRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGGHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKGNSDKLIAR

KKDWDPKKYGGFNSPTVAYSVLVVAKVEKGKSKKLKSVKELLGITIMERSS

FEKNPIDFLEAKGYKEVKKDLIIKLPKYSLFELENGRKRMLASAGVLQKGN

ELALPSKYVNFLYLASHYEKLKGSPEDNEQKQLFVEQHKHYLDEIIEQISE

FSKRVILADANLDKVLSAYNKHRDKPIREQAENIIHLFTLTNLGAPAAFKY

FDTTINRKQYNTTKEVLDATLIRQSITGLYETRIDLSQLGGD.

In some embodiments, the disclosed base editors comprise a napDNAbp domain that has a sequence that is at least 90%, at least 95%, at least 98%, or at least 99% identical to SpCas9-NRTH. In some embodiments, the disclosed base editors comprise a napDNAbp domain that comprises SpCas9-NRTH. The SpCas9-NRTH has an amino acid sequence as presented in SEQ ID NO: 178 (underligned residues are mutated relative to SpCas9):

(SEQ ID NO: 178)

MDKKYSIGLDIGTNSVGWAVITDEYKVPSKKFKVLGNTDRHSIKKNLIGAL

LFDSGETAEATRLKRTARRRYTRRKNRICYLQEIFSNEMAKVDDSFFHRLE

ESFLVEEDKKHERHPIFGNIVDEVAYHEKYPTIYHLRKKLVDSTDKADLRL

IYLALAHMIKFRGHFLIEGDLNPDNSDVDKLFIQLVQTYNQLFEENPINAS

GVDAKAILSARLSKSRRLENLIAQLPGEKKNGLFGNLIALSLGLTPNFKSN

FDLAEDAKLQLSKDTYDDDLDNLLAQIGDQYADLFLAAKNLSDAILLSDIL

RVNTEITKAPLSASMVKRYDEHHQDLTLLKALVRQQLPEKYKEIFFDQSKN

GYAGYIDGGASQEEFYKFIKPILEKMDGTEELLVKLNREDLLRKQRTFDNG

IIPHQIHLGELHAILRRQGDFYPFLKDNREKIEKILTFRIPYYVGPLARGN

SRFAWMTRKSEETITPWNFEEVVDKGASAQSFIERMTNFDKNLPNEKVLPK

HSLLYEYFTVYNELTKVKYVTEGMRKPAFLSGEQKKAIVDLLFKTNRKVTV

KQLKEDYFKKIECFDSVEISGVEDRFNASLGTYHDLLKIIKDKDFLDNEEN

EDILEDIVLTLTLFEDREMIEERLKTYAHLFDDKVMKQLKRLRYTGWGRLS

RKLINGIRDKQSGKTILDFLKSDGFANRNFMQLIHDDSLTFKEDIQKAQVS

GQGDSLHEHIANLAGSPAIKKGILQTVKVVDELVKVMGGHKPENIVIEMAR

ENQTTQKGQKNSRERMKRIEEGIKELGSQILKEHPVENTQLQNEKLYLYYL

QNGRDMYVDQELDINRLSDYDVDHIVPQSFLKDDSIDNKVLTRSDKNRGKS

DNVPSEEVVKKMKNYWRQLLNAKLITQRKFDNLTKAERGGLSELDKAGFIK

-continued

RQLVETRQITKHVAQILDSRMNTKYDENDKLIREVKVITLKSKLVSDFRKD

FQFYKVREINNYHHAHDAYLNAVVGTALIKKYPKLESEFVYGDYKVYDVRK

MIAKSEQEIGKATAKYFFYSNIMNFFKTEITLANGEIRKRPLIETNGETGE

IVWDKGRDFATVRKVLSMPQVNIVKKTEVQTGGFSKESILPKGNSDKLIAR

KKDWDPKKYGGFNSPTVAYSVLVVAKVEKGKSKKLKSVKELLGITIMERSS

FEKNPIGFLEAKGYKEVKKDLIIKLPKYSLFELENGRKRMLASASVLHKGN

ELALPSKYVNFLYLASHYEKLKGSSEDNKQKQLFVEQHKHYLDEIIEQISE

FSKRVILADANLDKVLSAYNKHRDKPIREQAENIIHLFTLTNLGASAAFKY

FDTTIGRKLYTSTKEVLDATLIHQSITGLYETRIDLSQLGGD.

In other embodiments, the napDNAbp of any of the disclosed base editors comprises a Cas9 derived from a *Streptococcus macacae*, e.g., *Streptococcus macacae* NCTC 11558, or SmacCas9, or a variant thereof. In some embodiments, the napDNAbp comprises a hybrid variant of SmacCas9 that incorporates an SpCas9 domain with the SmacCas9 domain and is known as Spy-macCas9, or a variant thereof. In some embodiments, the napDNAbp comprises a hybrid variant of SmacCas9 that incorporates an increased nucleolytic variant of an SpCas9 (iSpy Cas9) domain and is known as iSpy-macCas9. Relative to Spymac-Cas9, iSpy-Mac-Cas9 contains two mutations, R221K and N394K, that were identified by deep mutational scans of Spy Cas9 that raise modification rates of the protein on most targets. See Jakimo et al., bioRxiv, A Cas9 with Complete PAM Recognition for Adenine Dinucleotides (September 2018), herein incorporated by reference. Jakimo et al. showed that the hybrids Spy-macCas9 and iSpy-macCas9 recognize a short 5'-NAA-3' PAM and recognized all evaluated adenine dinucleotide PAM sequences and posseseds robust editing efficiency in human cells. Liu et al. engineered base editors containing Spy-mac Cas9, and demonstrated that cytidine and base editors containing Spymac domains can induce efficient C-to-T and A-to-G conversions in vivo. In addition, Liu et al. suggested that the PAM scope of Spy-mac Cas9 may be 5'-TAAA-3', rather than 5'-NAA-3' as reported by Jakimo et al. See Liu et al. *Cell Discovery* (2019) 5:58, herein incorporated by reference.

In some embodiments, the disclosed base editors comprise a napDNAbp domain that has a sequence that is at least 90%, at least 95%, at least 98%, or at least 99% identical to iSpyMac-Cas9. In some embodiments, the disclosed base editors comprise a napDNAbp domain that comprises iSpyMac-Cas9. The iSpyMac-Cas9 has an amino acid sequence as presented in SEQ ID NO: 179 (R221K and N394K mutations are underlined):

(SEQ ID NO: 179)

DKKYSIGLDIGTNSVGWAVITDEYKVPSKKFKVLGNTDRHSIKKNLIGALL

FDSGETAEATRLKRTARRRYTRRKNRICYLQEIFSNEMAKVDDSFFHRLEE

SFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASG

VDAKAILSARLSKSRKLENLIAQLPGEKKNGLFGNLIALSLGLTPNFKSNF

DLAEDAKLQLSKDTYDDDLDNLLAQIGDQYADLFLAAKNLSDAILLSDILR

VNTEITKAPLSASMIKRYDEHHQDLTLLKALVRQQLPEKYKEIFFDQSKNG

-continued

YAGYIDGGASQEEFYKFIKPILEKMDGTEELLVKLKREDLLRKQRTFDNGS

IPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKH

SLLYEYFTVYNELTKVKYVTEGMRKPAFLSGEQKKAIVDLLFKTNRKVTVK

QLKEDYFKKIECFDSVETSGVEDRFNASLGTYHDLLKIIKDKDFLDNEENE

DILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSG

QGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQ

NGRDMYVDQELDINRLSDYDVDHIVPQSFLKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEIQTVGQNGGLFDDNPKSPLEVTPS

KLVPLKKELNPKKYGGYQKPTTAYPVLLITDTKQLIPISVMNKKQFEQNPV

KFLRDRGYQQVGKNDFIKLPKYTLVDIGDGIKRLWASSKEIHKGNQLVVSK

KSQILLYHAHHLDSDLSNDYLQNHNQQFDVLFNEIISFSKKCKLGKEHIQK

IENVYSNKKNSASIEELAESFIKLLGFTQLGATSPFNFLGVKLNQKQYKGK

KDYILPCTEGTLIRQSITGLYETRVDLSKIGED.

In other embodiments, the napDNAbp of any of the disclosed base editors is a prokaryotic homolog of an Argonaute protein. Prokaryotic homologs of Argonaute proteins are known and have been described, for example, in Makarova K., et al., "Prokaryotic homologs of Argonaute proteins are predicted to function as key components of a novel system of defense against mobile genetic elements", *Biol Direct.* 2009 Aug. 25; 4:29. doi: 10.1186/1745-6150-4-29, the entire contents of which is hereby incorporated by reference. In some embodiments, the napDNAbp is a *Marinitoga piezophila* Argunaute (MpAgo) protein. The CRISPR-associated *Marinitoga piezophila* Argunaute (MpAgo) protein cleaves single-stranded target sequences using 5'-phosphorylated guides. The 5' guides are used by all known Argonautes. The crystal structure of an MpAgo-RNA complex shows a guide strand binding site comprising residues that block 5' phosphate interactions. This data suggests the evolution of an Argonaute subclass with noncanonical specificity for a 5'-hydroxylated guide. See, e.g., Kaya et al., "A bacterial Argonaute with noncanonical guide RNA specificity", *Proc Natl Acad Sci USA.* 2016 Apr. 12; 113(15):4057-62, the entire contents of which are hereby incorporated by reference). It should be appreciated that other argonaute proteins may be used, and are within the scope of this disclosure.

In some embodiments, the napDNAbp is a single effector of a microbial CRISPR-Cas system. Single effectors of microbial CRISPR-Cas systems include, without limitation, Cas9, Cpf1, C2c1, C2c2, and C2c3. Typically, microbial CRISPR-Cas systems are divided into Class 1 and Class 2 systems. Class 1 systems have multisubunit effector complexes, while Class 2 systems have a single protein effector. For example, Cas9 and Cpf1 are Class 2 effectors. In addition to Cas9 and Cpf1, three distinct Class 2 CRISPR- Cas systems (C2c1, C2c2, and C2c3) have been described by Shmakov et al., "Discovery and Functional Characterization of Diverse Class 2 CRISPR Cas Systems", Mol. Cell, 2015 Nov. 5; 60(3): 385-397, the entire contents of which is hereby incorporated by reference. Effectors of two of the systems, C2c1 and C2c3, contain RuvC-like endonuclease domains related to Cpf1. A third system, C2c2 contains an effector with two predicated HEPN RNase domains. Production of mature CRISPR RNA is tracrRNA-independent, unlike production of CRISPR RNA by C2c1. C2c1 depends on both CRISPR RNA and tracrRNA for DNA cleavage. Bacterial C2c2 has been shown to possess a unique RNase activity for CRISPR RNA maturation distinct from its RNA-activated single-stranded RNA degradation activity. These RNase functions are different from each other and from the CRISPR RNA-processing behavior of Cpf1. See, e.g., East-Seletsky, et al., "Two distinct RNase activities of CRISPR-C2c2 enable guide-RNA processing and RNA detection", *Nature,* 2016 Oct. 13; 538(7624):270-273, the entire contents of which are hereby incorporated by reference. In vitro biochemical analysis of C2c2 in Leptotrichia shahii has shown that C2c2 is guided by a single CRISPR RNA and can be programed to cleave ssRNA targets carrying complementary protospacers. Catalytic residues in the two conserved HEPN domains mediate cleavage. Mutations in the catalytic residues generate catalytically inactive RNA-binding proteins. See e.g., Abudayyeh et al., "C2c2 is a single-component programmable RNA-guided RNA-targeting CRISPR effector", *Science,* 2016 Aug. 5; 353(6299), the entire contents of which are hereby incorporated by reference.

The crystal structure of Alicyclobaccillus acidoterrastris C2c1 (AacC2c1) has been reported in complex with a chimeric single-molecule guide RNA (sgRNA). See e.g., Liu et al., "C2c1-sgRNA Complex Structure Reveals RNA-Guided DNA Cleavage Mechanism", *Mol. Cell,* 2017 Jan. 19; 65(2):310-322, the entire contents of which are hereby incorporated by reference. The crystal structure has also been reported in *Alicyclobacillus acidoterrestris* C2c1 bound to target DNAs as ternary complexes. See e.g., Yang et al., "PAM-dependent Target DNA Recognition and Cleavage by C2C1 CRISPR-Cas endonuclease", *Cell,* 2016 Dec. 15; 167(7):1814-1828, the entire contents of which are hereby incorporated by reference. Catalytically competent conformations of AacC2c1, both with target and non-target DNA strands, have been captured independently positioned within a single RuvC catalytic pocket, with C2c1-mediated cleavage resulting in a staggered seven-nucleotide break of target DNA. Structural comparisons between C2c1 ternary complexes and previously identified Cas9 and Cpf1 counterparts demonstrate the diversity of mechanisms used by CRISPR-Cas9 systems.

In some embodiments, the napDNAbp may be a C2c1, a C2c2, or a C2c3 protein. In some embodiments, the napDNAbp is a C2c1 protein. In some embodiments, the napDNAbp is a C2c2 protein. In some embodiments, the napDNAbp is a C2c3 protein. In some embodiments, the napDNAbp comprises an amino acid sequence that is at least 85%, at least 90%, at least 91%, at least 92%, at least 93%, at least 94%, at least 95%, at least 96%, at least 97%, at least 98%, at least 99%, or at least 99.5% identical to a naturally-occurring C2c1, C2c2, or C2c3 protein. In some embodiments, the napDNAbp is a naturally-occurring C2c1, C2c2, or C2c3 protein.

Some aspects of the disclosure provide Cas9 domains that have different PAM specificities. Typically, Cas9 proteins, such as Cas9 from *S. pyogenes* (spCas9), require a canonical NGG PAM sequence to bind a particular nucleic acid region. This may limit the ability to edit desired bases within a genome. In some embodiments, the base editing base editors provided herein may need to be placed at a precise location, for example where a target base is placed within a 4 base region (e.g., a "editing window" or a "target window"), which is approximately 15 bases upstream of the PAM. See Komor, A. C., et al., "Programmable editing of a target base in genomic DNA without double-stranded DNA cleavage" Nature 533, 420-424 (2016), the entire contents of which are hereby incorporated by reference. Accordingly, in some embodiments, any of the base editors provided herein may contain a Cas9 domain that is capable of binding a nucleotide sequence that does not contain a canonical (e.g., NGG) PAM sequence. Cas9 domains that bind to non-canonical PAM sequences have been described in the art and would be apparent to the skilled artisan. For example, Cas9 domains that bind non-canonical PAM sequences have been described in Kleinstiver, B. P., et al., "Engineered CRISPR-Cas9 nucleases with altered PAM specificities" Nature 523, 481-485 (2015); and Kleinstiver, B. P., et al., "Broadening the targeting range of *Staphylococcus aureus* CRISPR-Cas9 by modifying PAM recognition" Nature Biotechnology 33, 1293-1298 (2015); the entire contents of each are hereby incorporated by reference.

For example, a napDNAbp domain with altered PAM specificity, such as a domain with at least 80%, at least 85%, at least 90%, at least 95%, or at least 99% sequence identity with wild type *Francisella novicida* Cpf1 (SEQ ID NO: 180) (D917, E1006, and D1255), which has the following amino acid sequence:

(SEQ ID NO: 180)

```
MSIYQEFVNKYSLSKTLRFELIPQGKTLENIKARGLILDDEKRAKDYKKAK
QIIDKYHQFFIEEILSSVCISEDLLQNYSDVYFKLKKSDDDNLQKDFKSAK
DTIKKQISEYIKDSEKFKNLFNQNLIDAKKGQESDLILWLKQSKDNGIELF
KANSDITDIDEALEIIKSFKGWTTYFKGFHENRKNVYSSNDIPTSIIYRIV
DDNLPKFLENKAKYESLKDKAPEAINYEQIKKDLAEELTFDIDYKTSEVNQ
RVFSLDEVFEIANFNNYLNQSGITKFNTIIGGKFVNGENTKRKGINEYINL
YSQQINDKTLKKYKMSVLFKQILSDTESKSFVIDKLEDDSDVVTTMQSFYE
QIAAFKTVEEKSIKETLSLLFDDLKAQKLDLSKIYFKNDKSLTDLSQQVFD
DYSVIGTAVLEYITQQIAPKNLDNPSKKEQELIAKKTEKAKYLSLETIKLA
LEEFNKHRDIDKQCRFEEILANFAAIPMWDEIAQNKDNLAQISIKYQNQGK
KDLLQASAEDDVKAIKDLLDQTNNLLHKLKIFHISQSEDKANILDKDEHFY
LVFEECYFELANIVPLYNKIRNYITQKPYSDEKFKLNFENSTLANGWDKNK
EPDNTAILFIKDDKYYLGVMNKKNNKIFDDKAIKENKGEGYKKIVYKLLPG
ANKMLPKVFFSAKSIKFYNPSEDILRIRNHSTHTKNGSPQKGYEKFEFNIE
DCRKFIDFYKQSISKHPEWKDFGFRFSDTQRYNSIDEFYREVENQGYKLTF
ENISESYIDSVVNQGKLYLFQIYNKDFSAYSKGRPNLHTLYWKALFDERNL
QDVVYKLNGEAELFYRKQSIPKKITHPAKEAIANKNKDNPKKESVFEYDLI
KDKRFTEDKFFFHCPITINFKSSGANKFNDEINLLLKEKANDVHILSIDRG
ERHLAYYTLVDGKGNIIKQDTFNIIGNDRMKTNYHDKLAAIEKDRDSARKD
WKKINNIKEMKEGYLSQVVHEIAKLVIEYNAIVVFEDLNFGFKRGRFKVEK
```

-continued

QVYQKLEKMLIEKLNYLVFKDNEFDKTGGVLRAYQLTAPFETFKKMGKQTG

IIYYVPAGFTSKICPVTGFVNQLYPKYESVSKSQEFFSKFDKICYNLDKGY

FEFSFDYKNFGDKAAKGKWTIASFGSRLINFRNSDKNHNWDTREVYPTKEL

EKLLKDYSIEYGHGECIKAAICGESDKKFFAKLTSVLNTILQMRNSKTGTE

LDYLISPVADVNGNFFDSRQAPKNMPQDADANGAYHIGLKGLMLLGRIKNN

QEGKKLNLVIKNEEYFEFVQNRNN

An additional napDNAbp domain with altered PAM specificity, such as a domain having at least 80%, at least 85%, at least 90%, at least 95%, or at least 99% sequence identity with wild type *Geobacillus thermodenitrificans* Cas9 (SEQ ID NO: 181), which has the following amino acid sequence:

(SEQ ID NO: 181)

MKYKIGLDIGITSIGWAVINLDIPRIEDLGVRIFDRAENPKTGESLALPRR

LARSARRRLRRRKHRLERIRRLFVREGILTKEELNKLFEKKHEIDVWQLRV

EALDRKLNNDELARILLHLAKRRGFRSNRKSERTNKENSTMLKHIEENQSI

LSSYRTVAEMVVKDPKFSLHKRNKEDNYTNTVARDDLEREIKLIFAKQREY

GNIVCTEAFEHEYISIWASQRPFASKDDIEKKVGFCTFEPKEKRAPKATYT

FQSFTVWEHINKLRLVSPGGIRALTDDERRLIYKQAFHKNKITFHDVRTLL

NLPDDTRFKGLLYDRNTTLKENEKVRFLELGAYHKIRKAIDSVYGKGAAKS

FRPIDFDTFGYALTMFKDDTDIRSYLRNEYEQNGKRMENLADKVYDEELIE

ELLNLSFSKFGHLSLKALRNILPYMEQGEVYSTACERAGYTFTGPKKKQKT

VLLPNIPPIANPVVMRALTQARKVVNAIIKKYGSPVSIHIELARELSQSFD

ERRKMQKEQEGNRKKNETAIRQLVEYGLTLNPTGLDIVKFKLWSEQNGKCA

YSLQPIEIERLLEPGYTEVDHVIPYSRSLDDSYTNKVLVLTKENREKGNRT

PAEYLGLGSERWQQFETFVLTNKQFSKKKRDRLLRLHYDENEENEFKNRNL

NDTRYISRFLANFIREHLKFADSDDKQKVYTVNGRITAHLRSRWNFNKNRE

ESNLHHAVDAAIVACTTPSDIARVTAFYQRREQNKELSKKTDPQFPQPWPH

FADELQARLSKNPKESIKALNLGNYDNEKLESLQPVFVSRMPKRSITGAAH

QETLRRYIGIDERSGKIQTVVKKKLSEIQLDKTGHFPMYGKESDPRTYEAI

RQRLLEHNNDPKKAFQEPLYKPKKNGELGPIIRTIKIIDTTNQVIPLNDGK

TVAYNSNIVRVDVFEKDGKYYCVPIYTIDMMKGILPNKAIEPNKPYSEWKE

MTEDYTFRFSLYPNDLIRIEFPREKTIKTAVGEEIKIKDLFAYYQTIDSSN

GGLSLVSHDNNFSLRSIGSRTLKRFEKYQVDVLGNIYKVRGEKRVGVASSS

HSKAGETIRPL

In some embodiments, the nucleic acid programmable DNA binding protein (napDNAbp) is a nucleic acid programmable DNA binding protein that does not require a canonical (NGG) PAM sequence. In some embodiments, the napDNAbp is an argonaute protein. One example of such a nucleic acid programmable DNA binding protein is an Argonaute protein from *Natronobacterium gregoryi* (NgAgo). NgAgo is a ssDNA-guided endonuclease. NgAgo binds 5' phosphorylated ssDNA of ~24 nucleotides (gDNA) to guide it to its target site and will make DNA double-strand breaks at the gDNA site. In contrast to Cas9, the NgAgo-gDNA system does not require a protospacer-adjacent motif (PAM). Using a nuclease inactive NgAgo (dNgAgo) can greatly expand the bases that may be targeted. The characterization and use of NgAgo have been described in Gao et al., *Nat Biotechnol.,* 34(7): 768-73 (2016), PubMed PMID: 27136078; Swarts et al., Nature, 507(7491): 258-61 (2014); and Swarts et al., Nucleic Acids Res. 43(10) (2015): 5120-9, each of which is incorporated herein by reference. The sequence of *Natronobacterium gregoryi* Argonaute is provided in SEQ ID NO: 182.

The disclosed base editors may comprise a napDNAbp domain having at least 80%, at least 85%, at least 90%, at least 95%, or at least 99% sequence identity with wild type *Natronobacterium gregoryi* Argonaute (SEQ ID NO: 182), which has the following amino acid sequence:

(SEQ ID NO: 182)

MTVIDLDSTTTADELTSGHTYDISVTLTGVYDNTDEQHPRMSLAFEQDNGE

RRYITLWKNTTPKDVFTYDYATGSTYIFTNIDYEVKDGYENLTATYQTTVE

NATAQEVGTTDEDETFAGGEPLDHHLDDALNETPDDAETESDSGHVMTSFA

SRDQLPEWTLHTYTLTATDGAKTDTEYARRTLAYTVRQELYTDHDAAPVAT

DGLMLLTPEPLGETPLDLDCGVRVEADETRTLDYTTAKDRLLARELVEEGL

KRSLWDDYLVRGIDEVLSKEPVLTCDEFDLHERYDLSVEVGHSGRAYLHIN

FRHRFVPKLTLADIDDDNIYPGLRVKTTYRPRRGHIVWGLRDECATDSLNT

LGNQSVVAYHRNNQTPINTDLLDAIEAADRRVVETRRQGHGDDAVSFPQEL

LAVEPNTHQIKQFASDGFHQQARSKTRLSASRCSEKAQAFAERLDPVRLNG

STVEFSSEFFTGNNEQQLRLLYENGESVLTFRDGARGAHPDETFSKGIVNP

PESFEVAVVLPEQQADTCKAQWDTMADLLNQAGAPPTRSETVQYDAFSSPE

SISLNVAGAIDPSEVDAAFVVLPPDQEGFADLASPTETYDELKKALANMGI

YSQMAYFDRFRDAKIFYTRNVALGLLAAAGGVAFTTEHAMPGDADMFIGID

VSRSYPEDGASGQINIAATATAVYKDGTILGHSSTRPQLGEKLQSTDVRDI

MKNAILGYQQVTGESPTHIVIHRDGFMNEDLDPATEFLNEQGVEYDIVEIR

KQPQTRLLAVSDVQYDTPVKSIAAINQNEPRATVATFGAPEYLATRDGGGL

PRPIQIERVAGETDIETLTRQVYLLSQSHIQVHNSTARLPITTAYADQAST

HATKGYLVQTGAFESNVGFL

Cas9 Circular Permutants

In various embodiments, the base editors disclosed herein may comprise a circular permutant of Cas9.

The term "circularly permuted Cas9" or "circular permutant" of Cas9 or "CP-Cas9") refers to any Cas9 protein, or variant thereof, that occurs or has been modify to engineered as a circular permutant variant, which means the N-terminus and the C-terminus of a Cas9 protein (e.g., a wild type Cas9 protein) have been topically rearranged. Such circularly permuted Cas9 proteins, or variants thereof, retain the ability to bind DNA when complexed with a guide RNA (gRNA). See, Oakes et al., "Protein Engineering of Cas9 for enhanced function," *Methods Enzymol,* 2014, 546: 491-511 and Oakes et al., "CRISPR-Cas9 Circular Permutants as Programmable Scaffolds for Genome Modification," Cell, Jan. 10, 2019, 176: 254-267, and Huang, T. P. et al. Circularly permuted and PAM-modified Cas9 variants broaden the targeting scope of base editors. *Nat. Biotechnol.* 37, 626-631 (2019). each of are incorporated herein by reference. Reference is also made to International Application No. PCT/US2019/47996, filed Aug. 23, 2019, herein incorporated by reference. The instant disclosure contemplates any previously known CP-Cas9 or use a new CP-Cas9 so long as the resulting circularly permuted protein retains the ability to bind DNA when complexed with a guide RNA (gRNA).

Any of the Cas9 proteins described herein, including any variant, ortholog, or naturally occurring Cas9 or equivalent thereof, may be reconfigured as a circular permutant variant.

In various embodiments, the circular permutants of Cas9 may have the following structure: N-terminus-[original C-terminus]-[optional linker]-[original N-terminus]-C-terminus.

As an example, the present disclosure contemplates the following circular permutants of canonical *S. pyogenes* Cas9 (1368 amino acids of UniProtKB—Q99ZW2 (CAS9_STRP1) (numbering is based on the amino acid position in SEQ ID NO: 141):

N-terminus-[1268-1368]-[optional linker]-[1-1267]-C-terminus;

N-terminus-[1168-1368]-[optional linker]-[1-1167]-C-terminus;

N-terminus-[1068-1368]-[optional linker]-[1-1067]-C-terminus;

N-terminus-[968-1368]-[optional linker]-[1-967]-C-terminus;

N-terminus-[868-1368]-[optional linker]-[1-867]-C-terminus;

N-terminus-[768-1368]-[optional linker]-[1-767]-C-terminus;

N-terminus-[668-1368]-[optional linker]-[1-667]-C-terminus;

N-terminus-[568-1368]-[optional linker]-[1-567]-C-terminus;

N-terminus-[468-1368]-[optional linker]-[1-467]-C-terminus;

N-terminus-[368-1368]-[optional linker]-[1-367]-C-terminus;

N-terminus-[268-1368]-[optional linker]-[1-267]-C-terminus;

N-terminus-[168-1368]-[optional linker]-[1-167]-C-terminus;

N-terminus-[68-1368]-[optional linker]-[1-67]-C-terminus; or

N-terminus-[10-1368]-[optional linker]-[1-9]-C-terminus, or the corresponding circular permutants of other Cas9 proteins (including other Cas9 orthologs, variants, etc).

In particular embodiments, the circular permuant Cas9 has the following structure (based on *S. pyogenes* Cas9 (1368 amino acids of UniProtKB-Q99ZW2 (CAS9_STRP1) (numbering is based on the amino acid position in SEQ ID NO: 141):

N-terminus-[102-1368]-[optional linker]-[1-101]-C-terminus;

N-terminus-[1028-1368]-[optional linker]-[1-1027]-C-terminus;

N-terminus-[1041-1368]-[optional linker]-[1-1043]-C-terminus;

N-terminus-[1249-1368]-[optional linker]-[1-1248]-C-terminus; or

N-terminus-[1300-1368]-[optional linker]-[1-1299]-C-terminus, or the corresponding circular permutants of other Cas9 proteins (including other Cas9 orthologs, variants, etc).

In still other embodiments, the circular permuant Cas9 has the following structure (based on *S. pyogenes* Cas9 (1368 amino acids of UniProtKB-Q99ZW2 (CAS9_STRP1) (numbering is based on the amino acid position in SEQ ID NO: 141):

N-terminus-[103-1368]-[optional linker]-[1-102]-C-terminus;

N-terminus-[1029-1368]-[optional linker]-[1-1028]-C-terminus;

N-terminus-[1042-1368]-[optional linker]-[1-1041]-C-terminus;

N-terminus-[1250-1368]-[optional linker]-[1-1249]-C-terminus; or

N-terminus-[1301-1368]-[optional linker]-[1-1300]-C-terminus, or the corresponding circular permutants of other Cas9 proteins (including other Cas9 orthologs, variants, etc.).

In some embodiments, the circular permutant can be formed by linking a C-terminal fragment of a Cas9 to an N-terminal fragment of a Cas9, either directly or by using a linker, such as an amino acid linker. In some embodiments, The C-terminal fragment may correspond to the C-terminal 95% or more of the amino acids of a Cas9 (e.g., amino acids about 1300-1368), or the C-terminal 90%, 85%, 80%, 75%, 70%, 65%, 60%, 55%, 50%, 45%, 40%, 35%, 30%, 25%, 20%, 15%, 10%, or 5% or more of a Cas9. The N-terminal portion may correspond to the N-terminal 95% or more of the amino acids of a Cas9 (e.g., amino acids about 1-1300), or the N-terminal 90%, 85%, 80%, 75%, 70%, 65%, 60%, 55%, 50%, 45%, 40%, 35%, 30%, 25%, 20%, 15%, 10%, or 5% or more of a Cas9 (e.g., of SEQ ID NO: 141).

In some embodiments, the circular permutant can be formed by linking a C-terminal fragment of a Cas9 to an N-terminal fragment of a Cas9, either directly or by using a linker, such as an amino acid linker. In some embodiments, the C-terminal fragment that is rearranged to the N-terminus, includes or corresponds to the C-terminal 30% or less of the amino acids of a Cas9 (e.g., amino acids 1012-1368 of SEQ ID NO: 141). In some embodiments, the C-terminal fragment that is rearranged to the N-terminus, includes or corresponds to the C-terminal 30%, 29%, 28%, 27%, 26%, 25%, 24%, 23%, 22%, 21%, 20%, 19%, 18%, 17%, 16%, 15%, 14%, 13%, 12%, 11%, 10%, 9%, 8%, 7%, 6%, 5%, 4%, 3%, 2%, or 1% of the amino acids of a Cas9 (e.g., the Cas9 of SEQ ID NO: 141). In some embodiments, the C-terminal fragment that is rearranged to the N-terminus, includes or corresponds to the C-terminal 410 residues or less of a Cas9 (e.g., the Cas9 of SEQ ID NO: 141). In some embodiments, the C-terminal portion that is rearranged to the N-terminus, includes or corresponds to the C-terminal 410, 400, 390, 380, 370, 360, 350, 340, 330, 320, 310, 300, 290, 280, 270, 260, 250, 240, 230, 220, 210, 200, 190, 180, 170, 160, 150, 140, 130, 120, 110, 100, 90, 80, 70, 60, 50, 40, 30, 20, or 10 residues of a Cas9 (e.g., the Cas9 of SEQ ID NO: 141). In some embodiments, the C-terminal portion that is rearranged to the N-terminus, includes or corresponds to the C-terminal 357, 341, 328, 120, or 69 residues of a Cas9 (e.g., the Cas9 of SEQ ID NO: 141).

In other embodiments, circular permutant Cas9 variants may be defined as a topological rearrangement of a Cas9 primary structure based on the following method, which is based on *S. pyogenes* Cas9 of SEQ ID NO: 141: (a) selecting a circular permutant (CP) site corresponding to an internal amino acid residue of the Cas9 primary structure, which dissects the original protein into two halves: an N-terminal region and a C-terminal region; (b) modifying the Cas9 protein sequence (e.g., by genetic engineering techniques) by moving the original C-terminal region (comprising the CP site amino acid) to preceed the original N-terminal region, thereby forming a new N-terminus of the Cas9 protein that now begins with the CP site amino acid residue. The CP site can be located in any domain of the Cas9 protein, including, for example, the helical-II domain, the RuvCIII domain, or the CTD domain. For example, the CP site may be located (relative the *S. pyogenes* Cas9 of SEQ ID NO: 141) at original amino acid residue 181, 199, 230, 270, 310, 1010, 1016, 1023, 1029, 1041, 1247, 1249, or 1282. Thus, once relocated to the N-terminus, original amino acid 181, 199, 230, 270, 310, 1010, 1016, 1023, 1029, 1041, 1247, 1249, or 1282 would become the new N-terminal amino acid. Nomenclature of these CP-Cas9 proteins may be referred to as Cas9-CP181, Cas9-CP199, Cas9-CP230, Cas9-CP270, Cas9-CP310, Cas9-CP1010, Cas9-CP1016, Cas9-CP1023, Cas9-CP1029, Cas9-CP1041, Cas9-CP1247, Cas9-CP1249, and Cas9-CP1282, respectively. This description is not meant to be limited to making CP variants from SEQ ID NO: 141, but may be implemented to make CP variants in any Cas9 sequence, either at CP sites that correspond to these positions, or at other CP sites entireley. This description is not meant to limit the specific CP sites in any way. Virtually any CP site may be used to form a CP-Cas9 variant.

Exemplary CP-Cas9 amino acid sequences, based on the wild-type SpCas9 of SEQ ID NO: 141, are provided below in which linker sequences are indicated by underlining and optional methionine (M) residues are indicated in bold. It should be appreciated that the disclosure provides CP-Cas9 sequences that do not include a linker sequence or that include different linker sequences. It should be appreciated that CP-Cas9 sequences may be based on Cas9 sequences other than that of SEQ ID NO: 141 and any examples provided herein are not meant to be limiting. Exemplary CP-Cas9 sequences are as follows:

| CPname | Sequence | SEQ ID NO: |
|---|---|---|
| CP1012 | DYKVYDVRKMIAKSEQEIGKATAKYFFYSNIMNFFKT<br>EITLANGEIRKRPLIETNGETGEIVWDKGRDFATVRKVL<br>SMPQVNIVKKTEVQTGGFSKESILPKRNSDKLIARKKD<br>WDPKKYGGFDSPTVAYSVLVVAKVEKGKSKKLKSVK<br>ELLGITIMERSSFEKNPIDFLEAKGYKEVKKDLIIKLPKY<br>SLFELENGRKRMLASAGELQKGNELALPSKYVNFLYL<br>ASHYEKLKGSPEDNEQKQLFVEQHKHYLDEIIEQISEFS<br>KRVILADANLDKVLSAYNKHRDKPIREQAENIIHLFTLT<br>NLGAPAAFKYFDTTIDRKRYTSTKEVLDATLIHQSITGL<br>YETRIDLSQLGGDGGSGGSGGSGGSGGSGGSGGDKKY<br>SIGLAIGTNSVGWAVITDEYKVPSKKFKVLGNTDRHSI<br>KKNLIGALLFDSGETAEATRLKRTARRRYTRRKNRICY<br>LQEIFSNEMAKVDDSFFHRLEESFLVEEDKKHERHPIFG<br>NIVDEVAYHEKYPTIYHLRKKLVDSTDKADLRLIYLAL<br>AHMIKFRGHFLIEGDLNPDNSDVDKLFIQLVQTYNQLF<br>EENPINASGVDAKAILSARLSKSRRLENLIAQLPGEKKN<br>GLFGNLIALSLGLTPNFKSNFDLAEDAKLQLSKDTYDD<br>DLDNLLAQIGDQYADLFLAAKNLSDAILLSDILRVNTEI<br>TKAPLSASMIKRYDEHHQDLTLLKALVRQQLPEKYKEI<br>FFDQSKNGYAGYIDGGASQEEFYKFIKPILEKMDGTEE<br>LLVKLNREDLLRKQRTFDNGSIPHQIHLGELHAILRRQE<br>DFYPFLKDNREKIEKILTFRIPYYVGPLARGNSRFAWM<br>TRKSEETITPWNFEEVVDKGASAQSFIERMTNFDKNLP<br>NEKVLPKHSLLYEYFTVYNELTKVKYVTEGMRKPAFL<br>SGEQKKAIVDLLFKTNRKVTVKQLKEDYFKKIECFDSV<br>EISGVEDRFNASLGTYHDLLKIIKDKDFLDNEENEDILE<br>DIVLTLTLFEDREMIEERLKTYAHLFDDKVMKQLKRRR<br>YTGWGRLSRKLINGIRDKQSGKTILDFLKSDGFANRNF<br>MQLIHDDSLTFKEDIQKAQVSGQGDSLHEHIANLAGSP<br>AIKKGILQTVKVVDELVKVMGRHKPENIVIEMARENQ<br>TTQKGQKNSRERMKRIEEGIKELGSQILKEHPVENTQL<br>QNEKLYLYYLQNGRDMYVDQELDINRLSDYDVDHIVP<br>QSFLKDDSIDNKVLTRSDKNRGKSDNVPSEEVVKKMK<br>NYWRQLLNAKLITQRKFDNLTKAERGGLSELDKAGFI<br>KRQLVETRQITKHVAQILDSRMNTKYDENDKLIREVK<br>VITLKSKLVSDFRKDFQFYKVREINNYHHAHDAYLNA<br>VVGTALIKKYPKLESEFVYG | SEQ ID NO: 183 |
| CP1028 | EIGKATAKYFFYSNIMNFFKTEITLANGEIRKRPLIETNG<br>ETGEIVWDKGRDFATVRKVLSMPQVNIVKKTEVQTGG<br>FSKESILPKRNSDKLIARKKDWDPKKYGGFDSPTVAYS<br>VLVVAKVEKGKSKKLKSVKELLGITIMERSSFEKNPIDF<br>LEAKGYKEVKKDLIIKLPKYSLFELENGRKRMLASAGE<br>LQKGNELALPSKYVNFLYLASHYEKLKGSPEDNEQKQ<br>LFVEQHKHYLDEIIEQISEFSKRVILADANLDKVLSAYN<br>KHRDKPIREQAENIIHLFTLTNLGAPAAFKYFDTTIDRK<br>RYTSTKEVLDATLIHQSITGLYETRIDLSQLGGDGGSGG<br>SGGSGGSGGSGGSGGMDKKYSIGLAIGTNSVGWAVIT<br>DEYKVPSKKFKVLGNTDRHSIKKNLIGALLFDSGETAE<br>ATRLKRTARRRYTRRKNRICYLQEIFSNEMAKVDDSFF<br>HRLEESFLVEEDKKHERHPIFGNIVDEVAYHEKYPTIYH<br>LRKKLVDSTDKADLRLIYLALAHMIKFRGHFLIEGDLN<br>PDNSDVDKLFIQLVQTYNQLFEENPINASGVDAKAILS<br>ARLSKSRRLENLIAQLPGEKKNGLFGNLIALSLGLTPNF<br>KSNFDLAEDAKLQLSKDTYDDDLDNLLAQIGDQYADL<br>FLAAKNLSDAILLSDILRVNTEITKAPLSASMIKRYDEH<br>HQDLTLLKALVRQQLPEKYKEIFFDQSKNGYAGYIDG | SEQ ID NO: 184 |

-continued

| CPname | Sequence | SEQ ID NO: |
|---|---|---|
| | GASQEEFYKFIKPILEKMDGTEELLVKLNREDLLRKQR | |
| | TFDNGSIPHQIHLGELHAILRRQEDFYPFLKDNREKIEKI | |
| | LTFRIPYYVGPLARGNSRFAWMTRKSEETITPWNFEEV | |
| | VDKGASAQSFIERMTNFDKNLPNEKVLPKHSLLYEYFT | |
| | VYNELTKVKYVTEGMRKPAFLSGEQKKAIVDLLFKTN | |
| | RKVTVKQLKEDYFKKIECFDSVEISGVEDRFNASLGTY | |
| | HDLLKIIKDKDFLDNEENEDILEDIVLTLTLFEDREMIEE | |
| | RLKTYAHLFDDKVMKQLKRRRYTGWGRLSRKLINGIR | |
| | DKQSGKTILDFLKSDGFANRNFMQLIHDDSLTFKEDIQ | |
| | KAQVSGQGDSLHEHIANLAGSPAIKKGILQTVKVVDEL | |
| | VKVMGRHKPENIVIEMARENQTTQKGQKNSRERMKRI | |
| | EEGIKELGSQILKEHPVENTQLQNEKLYLYYLQNGRD | |
| | MYVDQELDINRLSDYDVDHIVPQSFLKDDSIDNKVLTR | |
| | SDKNRGKSDNVPSEEVVKKMKNYWRQLLNAKLITQR | |
| | KFDNLTKAERGGLSELDKAGFIKRQLVETRQITKHVAQ | |
| | ILDSRMNTKYDENDKLIREVKVITLKSKLVSDFRKDFQ | |
| | FYKVREINNYHHAHDAYLNAVVGTALIKKYPKLESEF | |
| | VYGDYKVYDVRKMIAKSEQ | |
| CP1041 | NIMNFFKTEITLANGEIRKRPLIETNGETGEIVWDKGRD | SEQ ID NO: |
| | FATVRKVLSMPQVNIVKKTEVQTGGFSKESILPKRNSD | 185 |
| | KLIARKKDWDPKKYGGFDSPTVAYSVLVVAKVEKGK | |
| | SKKLKSVKELLGITIMERSSFEKNPIDFLEAKGYKEVKK | |
| | DLIIKLPKYSLFELENGRKRMLASAGELQKGNELALPS | |
| | KYVNFLYLASHYEKLKGSPEDNEQKQLFVEQHKHYLD | |
| | EIIEQISEFSKRVILADANLDKVLSAYNKHRDKPIREQA | |
| | ENIIHLFTLTNLGAPAAFKYFDTTIDRKRYTSTKEVLDA | |
| | TLIHQSITGLYETRIDLSQLGGDGGSGGSGGSGGSGGSG | |
| | GSGGDKKYSIGLAIGTNSVGWAVITDEYKVPSKKFKVL | |
| | GNTDRHSIKKNLIGALLFDSGETAEATRLKRTARRRYT | |
| | RRKNRICYLQEIFSNEMAKVDDSFFHRLEESFLVEEDK | |
| | KHERHPIFGNIVDEVAYHEKYPTIYHLRKKLVDSTDKA | |
| | DLRLIYLALAHMIKFRGHFLIEGDLNPDNSDVDKLFIQL | |
| | VQTYNQLFEENPINASGVDAKAILSARLSKSRRLENLIA | |
| | QLPGEKKNGLFGNLIALSLGLTPNFKSNFDLAEDAKLQ | |
| | LSKDTYDDDLDNLLAQIGDQYADLFLAAKNLSDAILLS | |
| | DILRVNTEITKAPLSASMIKRYDEHHQDLTLLKALVRQ | |
| | QLPEKYKEIFFDQSKNGYAGYIDGGASQEEFYKFIKPIL | |
| | EKMDGTEELLVKLNREDLLRKQRTFDNGSIPHQIHLGE | |
| | LHAILRRQEDFYPFLKDNREKIEKILTFRIPYYVGPLAR | |
| | GNSRFAWMTRKSEETITPWNFEEVVDKGASAQSFIER | |
| | MTNFDKNLPNEKVLPKHSLLYEYFTVYNELTKVKYVT | |
| | EGMRKPAFLSGEQKKAIVDLLFKTNRKVTVKQLKEDY | |
| | FKKIECFDSVETSGVEDRFNASLGTYHDLLKIIKDKDFL | |
| | DNEENEDILEDIVLTLTLFEDREMIEERLKTYAHLFDDK | |
| | VMKQLKRRRYTGWGRLSRKLINGIRDKQSGKTILDFL | |
| | KSDGFANRNFMQLIHDDSLTFKEDIQKAQVSGQGDSL | |
| | HEHIANLAGSPAIKKGILQTVKVVDELVKVMGRHKPE | |
| | NIVIEMARENQTTQKGQKNSRERMKRIEEGIKELGSQIL | |
| | KEHPVENTQLQNEKLYLYYLQNGRDMYVDQELDINR | |
| | LSDYDVDHIVPQSFLKDDSIDNKVLTRSDKNRGKSDNV | |
| | PSEEVVKKMKNYWRQLLNAKLITQRKFDNLTKAERG | |
| | GLSELDKAGFIKRQLVETRQITKHVAQILDSRMNTKYD | |
| | ENDKLIREVKVITLKSKLVSDFRKDFQFYKVREINNYH | |
| | HAHDAYLNAVVGTALIKKYPKLESEFVYGDYKVYDV | |
| | RKMIAKSEQEIGKATAKYFFYS | |
| CP1249 | PEDNEQKQLFVEQHKHYLDEIIEQISEFSKRVILADANL | SEQ ID NO: |
| | DKVLSAYNKHRDKPIREQAENIIHLFTLTNLGAPAAFK | 186 |
| | YFDTTIDRKRYTSTKEVLDATLIHQSITGLYETRIDLSQL | |
| | GGDGGSGGSGGSGGSGGSGGSGGMDKKYSIGLAIGTN | |
| | SVGWAVITDEYKVPSKKFKVLGNTDRHSIKKNLIGALL | |
| | FDSGETAEATRLKRTARRRYTRRKNRICYLQEIFSNEM | |
| | AKVDDSFFHRLEESFLVEEDKKHERHPIFGNIVDEVAY | |
| | HEKYPTIYHLRKKLVDSTDKADLRLIYLALAHMIKFRG | |
| | HFLIEGDLNPDNSDVDKLFIQLVQTYNQLFEENPINASG | |
| | VDAKAILSARLSKSRRLENLIAQLPGEKKNGLFGNLIAL | |
| | SLGLTPNFKSNFDLAEDAKLQLSKDTYDDDLDNLLAQI | |
| | GDQYADLFLAAKNLSDAILLSDILRVNTEITKAPLSAS | |
| | MIKRYDEHHQDLTLLKALVRQQLPEKYKEIFFDQSKN | |
| | GYAGYIDGGASQEEFYKFIKPILEKMDGTEELLVKLNR | |
| | EDLLRKQRTFDNGSIPHQIHLGELHAILRRQEDFYPFLK | |
| | DNREKIEKILTFRIPYYVGPLARGNSRFAWMTRKSEETI | |
| | TPWNFEEVVDKGASAQSFIERMTNFDKNLPNEKVLPK | |
| | HSLLYEYFTVYNELTKVKYVTEGMRKPAFLSGEQKKA | |
| | IVDLLFKTNRKVTVKQLKEDYFKKIECFDSVETSGVED | |
| | RFNASLGTYHDLLKIIKDKDFLDNEENEDILEDIVLTLT | |

-continued

| CPname | Sequence | SEQ ID NO: |
|---|---|---|
| | LFEDREMIEERLKTYAHLFDDKVMKQLKRRRYTGWG | |
| | RLSRKLINGIRDKQSGKTILDFLKSDGFANRNFMQLIHD | |
| | DSLTFKEDIQKAQVSGQGDSLHEHIANLAGSPAIKKGIL | |
| | QTVKVVDELVKVMGRHKPENIVIEMARENQTTQKGQ | |
| | KNSRERMKRIEEGIKELGSQILKEHPVENTQLQNEKLY | |
| | LYYLQNGRDMYVDQELDINRLSDYDVDHIVPQSFLKD | |
| | DSIDNKVLTRSDKNRGKSDNVPSEEVVKKMKNYWRQ | |
| | LLNAKLITQRKFDNLTKAERGGLSELDKAGFIKRQLVE | |
| | TRQITKHVAQILDSRMNTKYDENDKLIREVKVITLKSK | |
| | LVSDFRKDFQFYKVREINNYHHAHDAYLNAVVGTALI | |
| | KKYPKLESEFVYGDYKVYDVRKMIAKSEQEIGKATAK | |
| | YFFYSNIMNFFKTEITLANGEIRKRPLIETNGETGEIVW | |
| | DKGRDFATVRKVLSMPQVNIVKKTEVQTGGFSKESILP | |
| | KRNSDKLIARKKDWDPKKYGGFDSPTVAYSVLVVAK | |
| | VEKGKSKKLKSVKELLGITIMERSSFEKNPIDFLEAKGY | |
| | KEVKKDLIIKLPKYSLFELENGRKRMLASAGELQKGNE | |
| | LALPSKYVNFLYLASHYEKLKGS | |
| CP1300 | KPIREQAENIIHLFTLTNLGAPAAFKYFDTTIDRKRYTST | SEQ ID NO: |
| | KEVLDATLIHQSITGLYETRIDLSQLGGDGGSGGSGGS | 187 |
| | GGSGGSGGSGGDKKYSIGLAIGTNSVGWAVITDEYKV | |
| | PSKKFKVLGNTDRHSIKKNLIGALLFDSGETAEATRLK | |
| | RTARRRYTRRKNRICYLQEIFSNEMAKVDDSFFHRLEE | |
| | SFLVEEDKKHERHPIFGNIVDEVAYHEKYPTIYHLRKK | |
| | LVDSTDKADLRLIYLALAHMIKFRGHFLIEGDLNPDNS | |
| | DVDKLFIQLVQTYNQLFEENPINASGVDAKAILSARLS | |
| | KSRRLENLIAQLPGEKKNGLFGNLIALSLGLTPNFKSNF | |
| | DLAEDAKLQLSKDTYDDDLDNLLAQIGDQYADLFLAA | |
| | KNLSDAILLSDILRVNTEITKAPLSASMIKRYDEHHQDL | |
| | TLLKALVRQQLPEKYKEIFFDQSKNGYAGYIDGGASQE | |
| | EFYKFIKPILEKMDGTEELLVKLNREDLLRKQRTFDNG | |
| | SIPHQIHLGELHAILRRQEDFYPFLKDNREKIEKILTFRIP | |
| | YYVGPLARGNSRFAWMTRKSEETITPWNFEEVVDKGA | |
| | SAQSFIERMTNFDKNLPNEKVLPKHSLLYEYFTVYNEL | |
| | TKVKYVTEGMRKPAFLSGEQKKAIVDLLFKTNRKVTV | |
| | KQLKEDYFKKIECFDSVEISGVEDRFNASLGTYHDLLKI | |
| | IKDKDFLDNEENEDILEDIVLTLTLFEDREMIEERLKTY | |
| | AHLFDDKVMKQLKRRRYTGWGRLSRKLINGIRDKQSG | |
| | KTILDFLKSDGFANRNFMQLIHDDSLTFKEDIQKAQVS | |
| | GQGDSLHEHIANLAGSPAIKKGILQTVKVVDELVKVM | |
| | GRHKPENIVIEMARENQTTQKGQKNSRERMKRIEEGIK | |
| | ELGSQILKEHPVENTQLQNEKLYLYYLQNGRDMYVDQ | |
| | ELDINRLSDYDVDHIVPQSFLKDDSIDNKVLTRSDKNR | |
| | GKSDNVPSEEVVKKMKNYWRQLLNAKLITQRKFDNL | |
| | TKAERGGLSELDKAGFIKRQLVETRQITKHVAQILDSR | |
| | MNTKYDENDKLIREVKVITLKSKLVSDFRKDFQFYKV | |
| | REINNYHHAHDAYLNAVVGTALIKKYPKLESEFVYGD | |
| | YKVYDVRKMIAKSEQEIGKATAKYFFYSNIMNFFKTEI | |
| | TLANGEIRKRPLIETNGETGEIVWDKGRDFATVRKVLS | |
| | MPQVNIVKKTEVQTGGFSKESILPKRNSDKLIARKKDW | |
| | DPKKYGGFDSPTVAYSVLVVAKVEKGKSKKLKSVKEL | |
| | LGITIMERSSFEKNPIDFLEAKGYKEVKKDLIIKLPKYSL | |
| | FELENGRKRMLASAGELQKGNELALPSKYVNFLYLAS | |
| | HYEKLKGSPEDNEQKQLFVEQHKHYLDEIIEQISEFSKR | |
| | VILADANLDKVLSAYNKHRD | |

The Cas9 circular permutants that may be useful in the base editor constructs described herein. Exemplary C-terminal fragments of Cas9, based on the Cas9 of SEQ TD NO: 141, which may be rearranged to an N-terminus of Cas9, are provided below. It should be appreciated that such C-terminal fragments of Cas9 are exemplary and are not meant to be limiting. These exemplary CP-Cas9 fragments have the following sequences:

| CP name | Sequence | SEQ ID NO: |
|---|---|---|
| CP1012C- | DYKVYDVRKMIAKSEQEIGKATAKYFFYSNIMNFFKT | SEQ ID NO: |
| C-terminal | EITLANGEIRKRPLIETNGETGEIVWDKGRDFATVRKVL | 188 |
| fragment | SMPQVNIVKKTEVQTGGFSKESILPKRNSDKLIARKKD | |
| | WDPKKYGGFDSPTVAYSVLVVAKVEKGKSKKLKSVK | |
| | ELLGITIMERSSFEKNPIDFLEAKGYKEVKKDLIIKLPKY | |
| | SLFELENGRKRMLASAGELQKGNELALPSKYVNFLYL | |
| | ASHYEKLKGSPEDNEQKQLFVEQHKHYLDEIIEQISEFS | |
| | KRVILADANLDKVLSAYNKHRDKPIREQAENIIHLFTLT | |
| | NLGAPAAFKYFDTTIDRKRYTSTKEVLDATLIHQSITGL | |
| | YETRIDLSQLGGD | |

-continued

| CP name | Sequence | SEQ ID NO: |
|---|---|---|
| CP1028 C-terminal fragment | EIGKATAKYFFYSNIMNFFKTEITLANGEIRKRPLIETNG ETGEIVWDKGRDFATVRKVLSMPQVNIVKKTEVQTGG FSKESILPKRNSDKLIARKKDWDPKKYGGFDSPTVAYS VLVVAKVEKGKSKKLKSVKELLGITIMERSSFEKNPIDF LEAKGYKEVKKDLIIKLPKYSLFELENGRKRMLASAGE LQKGNELALPSKYVNFLYLASHYEKLKGSPEDNEQKQ LFVEQHKHYLDEIIEQISEFSKRVILADANLDKVLSAYN KHRDKPIREQAENIIHLFTLTNLGAPAAFKYFDTTIDRK RYTSTKEVLDATLIHQSITGLYETRIDLSQLGGD | SEQ ID NO: 189 |
| CP1041 C-terminal fragment | NIMNFFKTEITLANGEIRKRPLIETNGETGEIVWDKGRD FATVRKVLSMPQVNIVKKTEVQTGGFSKESILPKRNSD KLIARKKDWDPKKYGGFDSPTVAYSVLVVAKVEKGK SKKLKSVKELLGITIMERSSFEKNPIDFLEAKGYKEVKK DLIIKLPKYSLFELENGRKRMLASAGELQKGNELALPS KYVNFLYLASHYEKLKGSPEDNEQKQLFVEQHKHYLD EIIEQISEFSKRVILADANLDKVLSAYNKHRDKPlREQA ENIIHLFTLTNLGAPAAFKYFDTTIDRKRYTSTKEVLDA TLIHQSITGLYETRIDLSQLGGD | SEQ ID NO: 190 |
| CP1249 C-terminal fragment | PEDNEQKQLFVEQHKHYLDEIIEQISEFSKRVILADANL DKVLSAYNKHRDKPIREQAENIIHLFTLTNLGAPAAFK YFDTTIDRKRYTSTKEVLDATLIHQSITGLYETRIDLSQL GGD | SEQ ID NO: 191 |
| CP1300 C-terminal fragment | KPIREQAENIIHLFTLTNLGAPAAFKYFDTTIDRKRYTST KEVLDATLIHQSITGLYETRIDLSQLGGD | SEQ ID NO: 192 |

Cas9 Variants with Modified PAM Specificities

The base editors of the present disclosure may also comprise Cas9 variants with modified PAM specificities. Some aspects of this disclosure provide Cas9 proteins that exhibit activity on a target sequence that does not comprise the canonical PAM (5'-NGG-3', where N is A, C, G, or T) at its 3'-end. In some embodiments, the Cas9 protein exhibits activity on a target sequence comprising a 5'-NGG-3' PAM sequence at its 3'-end. In some embodiments, the Cas9 protein exhibits activity on a target sequence comprising a 5'-NNG-3' PAM sequence at its 3'-end. In some embodiments, the Cas9 protein exhibits activity on a target sequence comprising a 5'-NNA-3' PAM sequence at its 3'-end. In some embodiments, the Cas9 protein exhibits activity on a target sequence comprising a 5'-NNC-3' PAM sequence at its 3'-end. In some embodiments, the Cas9 protein exhibits activity on a target sequence comprising a 5'-NNT-3' PAM sequence at its 3'-end. In some embodiments, the Cas9 protein exhibits activity on a target sequence comprising a 5'-NGT-3' PAM sequence at its 3'-end. In some embodiments, the Cas9 protein exhibits activity on a target sequence comprising a 5'-NGA-3' PAM sequence at its 3'-end. In some embodiments, the Cas9 protein exhibits activity on a target sequence comprising a 5'-NGC-3' PAM sequence at its 3'-end. In some embodiments, the Cas9 protein exhibits activity on a target sequence comprising a 5'-NAA-3' PAM sequence at its 3'-end. In some embodiments, the Cas9 protein exhibits activity on a target sequence comprising a 5'-NAC-3' PAM sequence at its 3'-end. In some embodiments, the Cas9 protein exhibits activity on a target sequence comprising a 5'-NAT-3' PAM sequence at its 3'-end. In still other embodiments, the Cas9 protein exhibits activity on a target sequence comprising a 5'-NAG-3' PAM sequence at its 3'-end.

In some embodiments, the disclosed base editors comprise a napDNAbp domain comprising a SpCas9-NG, which has a PAM that corresponds to NGN. In some embodiments, the disclosed base editors comprise a napDNAbp domain comprising a SpCas9-KKH, which has a PAM that corresponds to NNNRRT (SEQ ID NO: 116).

It should be appreciated that any of the amino acid mutations described herein, (e.g., A262T) from a first amino acid residue (e.g., A) to a second amino acid residue (e.g., T) may also include mutations from the first amino acid residue to an amino acid residue that is similar to (e.g., conserved) the second amino acid residue. For example, mutation of an amino acid with a hydrophobic side chain (e.g., alanine, valine, isoleucine, leucine, methionine, phenylalanine, tyrosine, or tryptophan) may be a mutation to a second amino acid with a different hydrophobic side chain (e.g., alanine, valine, isoleucine, leucine, methionine, phenylalanine, tyrosine, or tryptophan). For example, a mutation of an alanine to a threonine (e.g., a A262T mutation) may also be a mutation from an alanine to an amino acid that is similar in size and chemical properties to a threonine, for example, serine. As another example, mutation of an amino acid with a positively charged side chain (e.g., arginine, histidine, or lysine) may be a mutation to a second amino acid with a different positively charged side chain (e.g., arginine, histidine, or lysine). As another example, mutation of an amino acid with a polar side chain (e.g., serine, threonine, asparagine, or glutamine) may be a mutation to a second amino acid with a different polar side chain (e.g., serine, threonine, asparagine, or glutamine). Additional similar amino acid pairs include, but are not limited to, the following: phenylalanine and tyrosine; asparagine and glutamine; methionine and cysteine; aspartic acid and glutamic acid; and arginine and lysine. The skilled artisan would recognize that such conservative amino acid substitutions will likely have minor effects on protein structure and are likely to be well tolerated without compromising function. In some embodiments, any amino of the amino acid mutations provided herein from one amino acid to a threonine may be an amino acid mutation to a serine. In some embodiments, any amino of the amino acid mutations provided herein from one amino acid to an arginine may be an amino acid mutation to a lysine. In some embodiments, any amino of the amino acid mutations provided herein from one amino acid to an isoleucine, may be an amino acid mutation to an alanine, valine, methionine, or leucine. In some embodiments, any amino of the amino acid mutations provided herein from one amino acid to a lysine may be an amino acid mutation to an arginine. In some embodiments, any amino of the amino acid mutations provided herein from one amino acid to an aspartic acid may be an amino acid mutation to a glutamic acid or asparagine. In some embodiments, any amino of the amino acid mutations provided herein from one amino acid to a valine may be an amino acid mutation to an alanine, isoleucine, methionine, or leucine. In some embodiments, any amino of the amino acid mutations provided herein from one amino acid to a glycine may be an amino acid mutation to an alanine. It should be appreciated, however, that additional conserved amino acid residues would be recognized by the skilled artisan and any of the amino acid mutations to other conserved amino acid residues are also within the scope of this disclosure.

In some embodiments, the present disclosure may utilize any of the Cas9 variants disclosed in the SEQUENCES section herein.

In some embodiments, the Cas9 protein comprises a combination of mutations that exhibit activity on a target sequence comprising a 5'-NAA-3' PAM sequence at its 3'-end. In some embodiments, the combination of mutations are present in any one of the clones listed in Table 1. In some embodiments, the combination of mutations are conservative mutations of the clones listed in Table 1. In some embodiments, the Cas9 protein comprises the combination of mutations of any one of the Cas9 clones listed in Table 1.

TABLE 1

| NAA PAM Clones<br>Mutations from wild-type SpCas9 (e.g., SEQ ID NO: 141) |
|---|
| D177N, K218R, D614N, D1135N, P1137S, E1219V, A1320V, A1323D, R1333K |
| D177N, K218R, D614N, D1135N, E1219V, Q1221H, H1264Y, A1320V, R1333K |
| A10T, I322V, S409I, E427G, G715C, D1135N, E1219V, Q1221H, H1264Y, A1320V, R1333K |
| A367T, K710E, R1114G, D1135N, P1137S, E1219V, Q1221H, H1264Y, A1320V, R1333K |
| A10T, I322V, S409I, E427G, R753G, D861N, D1135N, K1188R, E1219V, Q1221H, H1264H, A1320V, R1333K |
| A10T, I322V, S409I, E427G, R654L, V743I, R753G, M1021T, D1135N, D1180G, K1211R, E1219V, Q1221H, H1264Y, A1320V, R1333K |
| A10T, I322V, S409I, E427G, V743I, R753G, E762G, D1135N, D1180G, K1211R, E1219V, Q1221H, H1264Y, A1320V, R1333K |
| A10T, I322V, S409I, E427G, R753G, D1135N, D1180G, K1211R, E1219V, Q1221H, H1264Y, S1274R, A1320V, R1333K |
| A10T, I322V, S409I, E427G, A589S, R753G, D1135N, E1219V, Q1221H, H1264H, A1320V, R1333K |
| A10T, I322V, S409I, E427G, R753G, E757K, G865G, D1135N, E1219V, Q1221H, H1264Y, A1320V, R1333K |
| A10T, I322V, S409I, E427G, R654L, R753G, E757K, D1135N, E1219V, Q1221H, H1264Y, A1320V, R1333K |
| A10T, I322V, S409I, E427G, K599R, M631A, R654L, K673E, V743I, R753G, N758H, E762G, D1135N, D1180G, E1219V, Q1221H, Q1256R, H1264Y, A1320V, A1323D, R1333K |
| A10T, I322V, S409I, E427G, R654L, K673E, V743I, R753G, E762G, N869S, N1054D, R1114G, D1135N, D1180G, E1219V, Q1221H, H1264Y, A1320V, A1323D, R1333K |
| A10T, I322V, S409I, E427G, R654L, L727I, V743I, R753G, E762G, R859S, N946D, F1134L, D1135N, D1180G, E1219V, Q1221H, H1264Y, N1317T, A1320V, A1323D, R1333K |
| A10T, I322V, S409I, E427G, R654L, K673E, V743I, R753G, E762G, N803S, N869S, Y1016D, G1077D, R1114G, F1134L, D1135N, D1180G, E1219V, Q1221H, H1264Y, V1290G, L1318S, A1320V, A1323D, R1333K |
| A10T, I322V, S409I, E427G, R654L, K673E, V743I, R753G, E762G, N803S, N869S, Y1016D, G1077D, R1114G, F1134L, D1135N, K1151E, D1180G, E1219V, Q1221H, H1264Y, V1290G, L1318S, A1320V, R1333K |
| A10T, I322V, S409I, E427G, R654L, K673E, V743I, R753G, E762G, N803S, N869S, Y1016D, G1077D, R1114G, F1134L, D1135N, D1180G, E1219V, Q1221H, H1264Y, V1290G, L1318S, A1320V, A1323D, R1333K |
| A10T, I322V, S409I, E427G, R654L, K673E, F693L, V743I, R753G, E762G, N803S, N869S, L921P, Y1016D, G1077D, F1080S, R1114G, D1135N, D1180G, E1219V, Q1221H, H1264Y, L1318S, A1320V, A1323D, R1333K |
| A10T, I322V, S409I, E427G, E630K, R654L, K673E, V743I, R753G, E762G, Q768H, N803S, N869S, Y1016D, G1077D, R1114G, F1134L, D1135N, D1180G, E1219V, Q1221H, H1264Y, L1318S, A1320V, R1333K |
| A10T, I322V, S409I, E427G, R654L, K673E, F693L, V743I, R753G, E762G, Q768H, N803S, N869S, Y1016D, G1077D, R1114G, F1134L, D1135N, D1180G, E1219V, Q1221H, G1223S, H1264Y, L1318S, A1320V, R1333K |
| A10T, I322V, S409I, E427G, R654L, K673E, F693L, V743I, R753G, E762G, N803S, N869S, L921P, Y1016D, G1077D, F1801S, R1114G, D1135N, D1180G, E1219V, Q1221H, H1264Y, L1318S, A1320V, A1323D, R1333K |
| A10T, I322V, S409I, E427G, R654L, V743I, R753G, M1021T, D1135N, D1180G, K1211R, E1219V, Q1221H, H1264Y, A1320V, R1333K |
| A10T, I322V, S409I, E427G, R654L, K673E, V743I, R753G, E762G, M673I, N803S, N869S, G1077D, R1114G, D1135N, V1139A, D1180G, E1219V, Q1221H, A1320V, R1333K |

TABLE 1-continued

| NAA PAM Clones<br>Mutations from wild-type SpCas9 (e.g., SEQ ID NO: 141) |
|---|
| A10T, I322V, S409I, E427G, R654L, K673E, V743I, R753G, E762G, N803S, N869S, R1114G, D1135N, E1219V, Q1221H, A1320V, R1333K |

In some embodiments, the Cas9 protein comprises an amino acid sequence that is at least 80% identical to the amino acid sequence of a Cas9 protein as provided by any one of the variants of Table 1. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 1.

In some embodiments, the Cas9 protein exhibits an increased activity on a target sequence that does not comprise the canonical PAM (5'-NGG-3') at its 3' end as compared to *Streptococcus pyogenes* Cas9 as provided by SEQ ID NO: 141. In some embodiments, the Cas9 protein exhibits an activity on a target sequence having a 3' end that is not directly adjacent to the canonical PAM sequence (5'-NGG-3') that is at least 5-fold increased as compared to the activity of *Streptococcus pyogenes* Cas9 as provided by SEQ ID NO: 141 on the same target sequence. In some embodiments, the Cas9 protein exhibits an activity on a target sequence that is not directly adjacent to the canonical PAM sequence (5'-NGG-3') that is at least 10-fold, at least 50-fold, at least 100-fold, at least 500-fold, at least 1,000-fold, at least 5,000-fold, at least 10,000-fold, at least 50,000-fold, at least 100,000-fold, at least 500,000-fold, or at least 1,000,000-fold increased as compared to the activity of *Streptococcus pyogenes* as provided by SEQ ID NO: 141 on the same target sequence. In some embodiments, the 3' end of the target sequence is directly adjacent to an AAA, GAA, CAA, or TAA sequence. In some embodiments, the Cas9 protein comprises a combination of mutations that exhibit activity on a target sequence comprising a 5'-NAC-3' PAM sequence at its 3'-end. In some embodiments, the combination of mutations are present in any one of the clones listed in Table 2. In some embodiments, the combination of mutations are conservative mutations of the clones listed in Table 2. In some embodiments, the Cas9 protein comprises the combination of mutations of any one of the Cas9 clones listed in Table 2.

TABLE 2

| NAC PAM Clones<br>Mutations from wild-type SpCas9 (e.g., SEQ ID NO: 141) |
|---|
| T472I, R753G, K890E, D1332N, R1335Q, T1337N |
| I1057S, D1135N, P1301S, R1335Q, T1337N |
| T472I, R753G, D1332N, R1335Q, T1337N |
| D1135N, E1219V, D1332N, R1335Q, T1337N |
| T472I, R753G, K890E, D1332N, R1335Q, T1337N |
| I1057S, D1135N, P1301S, R1335Q, T1337N |
| T472I, R753G, D1332N, R1335Q, T1337N |
| T472I, R753G, Q771H, D1332N, R1335Q, T1337N |
| E627K, T638P, K652T, R753G, N803S, K959N, R1114G, D1135N, E1219V, D1332N, R1335Q, T1337N |
| E627K, T638P, K652T, R753G, N803S, K959N, R1114G, D1135N, K1156E, E1219V, D1332N, R1335Q, T1337N |
| E627K, T638P, V647I, R753G, N803S, K959N, G1030R, I1055E, R1114G, D1135N, E1219V, D1332N, R1335Q, T1337N |
| E627K, E630G, T638P, V647A, G687R, N767D, N803S, K959N, R1114G, D1135N, E1219V, D1332G, R1335Q, T1337N |
| E627K, T638P, R753G, N803S, K959N, R1114G, D1135N, E1219V, N1266H, D1332N, R1335Q, T1337N |
| E627K, T638P, R753G, N803S, K959N, I1057T, R1114G, D1135N, E1219V, D1332N, R1335Q, T1337N |
| E627K, T638P, R753G, N803S, K959N, R1114G, D1135N, E1219V, D1332N, R1335Q, T1337N |
| E627K, M631I, T638P, R753G, N803S, K959N, Y1036H, R1114G, D1135N, E1219V, D1251G, D1332G, R1335Q, T1337N |
| E627K, T638P, R753G, N803S, V875I, K959N, Y1016C, R1114G, D1135N, E1219V, D1251G, D1332G, R1335Q, T1337N, 11348V |
| K608R, E627K, T638P, V647I, R654L, R753G, N803S, T804A, K848N, V922A, K959N, R1114G, D1135N, E1219V, D1332N, R1335Q, T1337N |
| K608R, E627K, T638P, V647I, R753G, N803S, V922A, K959N, K1014N, V1015A, R1114G, D1135N, K1156N, E1219V, N1252D, D1332N, R1335Q, T1337N |
| K608R, E627K, R629G, T638P, V647I, A711T, R753G, K775R, K789E, N803S, K959N, V1015A, Y1036H, R1114G, D1135N, E1219V, N1286H, D1332N, R1335Q, T1337N |
| K608R, E627K, T638P, V647I, T740A, R753G, N803S, K948E, K959N, Y1016S, R1114G, D1135N, E1219V, N1286H, D1332N, R1335Q, T1337N |
| K608R, E627K, T638P, V647I, T740A, N803S, K948E, K959N, Y1016S, R1114G, D1135N, E1219V, N1286H, D1332N, R1335Q, T1337N |
| I670S, K608R, E627K, E630G, T638P, V647I, R653K, R753G, I795L, K797N, N803S, K866R, K890N, K959N, Y1016C, R1114G, D1135N, E1219V, D1332N, R1335Q, T1337N |

TABLE 2-continued

| NAC PAM Clones<br>Mutations from wild-type SpCas9 (e.g., SEQ ID NO: 141) |
| --- |
| K608R, E627K, T638P, V647I, T740A, G752R, R753G, K797N, N803S, K948E, K959N, V1015A, Y1016S, R1114G, D1135N, E1219V, N1266H, D1332N, R1335Q, T1337N |
| I570T, A589V, K608R, E627K, T638P, V647I, R654L, Q716R, R753G, N803S, K948E, K959N, Y1016S, R1114G, D1135N, E1207G, E1219V, N1234D, D1332N, R1335Q, T1337N |
| K608R, E627K, R629G, T638P, V647I, R654L, Q740R, R753G, N803S, K959N, N990S, T995S, V1015A, Y1036D, R1114G, D1135N, E1207G, E1219V, N1234D, N1266H, D1332N, R1335Q, T1337N |
| I562F, V565D, I570T, K608R, L625S, E627K, T638P, V647I, R654I, G752R, R753G, N803S, N808D, K959N, M1021L, R1114G, D1135N, N1177S, N1234D, D1332N, R1335Q, T1337N |
| I562F, I570T, K608R, E627K, T638P, V647I, R753G, E790A, N803S, K959N, V1015A, Y1036H, R1114G, D1135N, D1180E, A1184T, E1219V, D1332N, R1335Q, T1337N |
| I570T, K608R, E627K, T638P, V647I, R654H, R753G, E790A, N803S, K959N, V1015A, R1114G, D1127A, D1135N, E1219V, D1332N, R1335Q, T1337N |
| I570T, K608R, L625S, E627K, T638P, V647I, R654I, T703P, R753G, N803S, N808D, K959N, M1021L, R1114G, D1135N, E1219V, D1332N, R1335Q, T1337N |
| I570S, K608R, E627K, E630G, T638P, V647I, R653K, R753G, I795L, N803S, K866R, K890N, K959N, Y1016C, R1114G, D1135N, E1219V, D1332N, R1335Q, T1337N |
| I570T, K608R, E627K, T638P, V647I, R654H, R753G, E790A, N803S, K959N, V1016A, R1114G, D1135N, E1219V, K1246E, D1332N, R1335Q, T1337N |
| K608R, E627K, T638P, V647I, R654L, K673E, R753G, E790A, N803S, K948E, K959N, R1114G, D1127G, D1135N, D1180E, E1219V, N1286H, D1332N, R1335Q, T1337N |
| K608R, L625S, E627K, T638P, V647I, R654I, I670T, R753G, N803S, N808D, K959N, M1021L, R1114G, D1135N, E1219V, N1286H, D1332N, R1335Q, T1337N |
| E627K, M631V, T638P, V647I, K710E, R753G, N803S, N808D, K948E, M1021L, R1114G, D1135N, E1219V, D1332N, R1335Q, T1337N, S1338T, H1349R |

In some embodiments, the Cas9 protein comprises an amino acid sequence that is at least 80% identical to the amino acid sequence of a Cas9 protein as provided by any one of the variants of Table 2. In some embodiments, the Cas9 protein comprises an amino acid sequence that is at least 85%, at least 90%, at least 92%, at least 95%, at least 96%, at least 97%, at least 98%, at least 99%, or at least 99.5% identical to the amino acid sequence of a Cas9 protein as provided by any one of the variants of Table 2.

In some embodiments, the Cas9 protein comprises a combination of mutations that exhibit activity on a target sequence comprising a 5'-NAT-3' PAM sequence at its Y-end. In some embodiments, the combination of mutations are present in any one of the clones listed in Table 3. In some embodiments, the combination of mutations are conservative mutations of the clones listed in Table 3. In some embodiments, the Cas9 protein comprises the combination of mutations of any one of the Cas9 clones listed in Table 3.

TABLE 3

| NAT PAM Clones<br>Mutations from wild-type SpCas9 (e.g., SEQ ID NO: 141) |
| --- |
| K961E, H985Y, D1135N, K1191N, E1219V, Q1221H, A1320A, P1321S, R1335L |
| D1135N, G1218S, E1219V, Q1221H, P1249S, P1321S, D1322G, R1335L |
| V743I, R753G, E790A, D1135N, G1218S, E1219V, Q1221H, A1227V, P1249S, N1286K, A1293T, P1321S, D1322G, R1335L, T1339I |
| F575S, M631L, R654L, V748I, V743I, R753G, D853E, V922A, R1114G D1135N, G1218S, E1219V, Q1221H, A1227V, P1249S, N1286K, A1293T, P1321S, D1322G, R1335L, T1339I |
| F575S, M631L, R654L, R664K, R753G, D853E, V922A, R1114G D1135N, D1180G, G1218S, E1219V, Q1221H, P1249S, N1286K, P1321S, D1322G, R1335L |
| M631L, R654L, R753G, K797E, D853E, V922A, D1012A, R1114G D1135N, G1218S, E1219V, Q1221H, P1249S, N1317K, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, D596Y, M631L, R654L, R664K, R753G, D853E, V922A, R1114G, Y1131C, D1135N, D1180G, G1218S, E1219V, Q1221H, P1249S, Q1256R, P1321S, D1322G, R1335L |
| F575S, M631L, R654L, R664K, K710E, V750A, R753G, D853E, V922A, R1114G, Y1131C, D1135N, D1180G, G1218S, E1219V, Q1221H, P1249S, P1321S, D1322G, R1335L |
| F575S, M631L, K649R, R654L, R664K, R753G, D853E, V922A, R1114G, Y1131C, D1135N, K1156E, D1180G, G1218S, E1219V, Q1221H, P1249S, P1321S, D1322G, R1335L |
| F575S, M631L, R654L, R664K, R753G, D853E, V922A, R1114G, Y1131C, D1135N, D1180G, G1218S, E1219V, Q1221H, P1249S, P1321S, D1322G, R1335L |
| F575S, M631L, R654L, R664K, R753G, D853E, V922A, I1057G, R1114G, Y1131C, D1135N, D1180G, G1218S, E1219V, Q1221H, P1249S, N1308D, P1321S, D1322G, R1335L |
| M631L, R654L, R753G, D853E, V922A, R1114G, Y1131C, D1135N, E1150V, D1180G, G1218S, E1219V, Q1221H, P1249S, P1321S, D1332G, R1335L |
| M631L, R654L, R664K, R753G, D853E, I1057V, Y1131C, D1135N, D1180G, G1218S, E1219V, Q1221H, P1249S, P1321S, D1332G, R1335L |

TABLE 3-continued

| NAT PAM Clones<br>Mutations from wild-type SpCas9 (e.g., SEQ ID NO: 141) |
|---|
| M631L, R654L, R664K, R753G, I1057V, R1114G, Y1131C, D1135N, D1180G, G1218S, E1219V, Q1221H, P1249S, P1321S, D1332G, R1335L |

The above description of various napDNAbps which can be used in connection with the presently disclose base editors is not meant to be limiting in any way. The base editors may comprise the canonical SpCas9, or any ortholog Cas9 protein, or any variant Cas9 protein—including any naturally occurring variant, mutant, or otherwise engineered version of Cas9—that is known or which can be made or evolved through a directed evolutionary or otherwise mutagenic process. In various embodiments, the Cas9 or Cas9 varants have a nickase activity, i.e., only cleave of strand of the target DNA sequence. In other embodiments, the Cas9 or Cas9 variants have inactive nucleases, i.e., are "dead" Cas9 proteins. Other variant Cas9 proteins that may be used are those having a smaller molecular weight than the canonical SpCas9 (e.g., for easier delivery) or having modified or rearranged primary amino acid structure (e.g., the circular permutant formats). The base editors described herein may also comprise Cas9 equivalents, including Cas12a/Cpf1 and Cas12b proteins which are the result of convergent evolution. The napDNAbps used herein (e.g., SpCas9, Cas9 variant, or Cas9 equivalents) may also may also contain various modifications that alter/enhance their PAM specifities. Lastly, the application contemplates any Cas9, Cas9 variant, or Cas9 equivalent which has at least 70%, at least 75%, at least 80%, at least 85%, at least 90%, at least 91%, at least 92%, at least 93%, at least 94%, at least 95%, at least 96%, at least 97%, at least 98%, at least 99%, or at least 99.9% sequence identity to a reference Cas9 sequence, such as a references SpCas9 canonical sequences or a reference Cas9 equivalent (e.g., Cas12a/Cpf1).

In a particular embodiment, the Cas9 variant having expanded PAM capabilities is SpCas9 (H840A) VRQR, or SpCas9-VRQR. In some embodiments, the disclosed base editors comprise a napDNAbp domain that has a sequence that is at least 90%, at least 95%, at least 98%, or at least 99% identical to SpCas9-VRQR. In some embodiments, the disclosed base editors comprise a napDNAbp domain that comprises SpCas9-VRQR. The SpCas9-VRQR comprises the following amino acid sequence (with the V, R, Q, R substitutions relative to the SpCas9 (H840A) of SEQ ID NO: 193 show, in bold underline. In addition, the methionine residue in SpCas9 (1H840) was removed for SpCas9 (H840A) VRQR):

```
                                        (SEQ ID NO: 193)
DKKYSIGLDIGTNSVGWAVITDEYKVPSKKFKVLGNTDRHSIKKNLIGALL

FDSGETAEATRLKRTARRRYTRRKNRICYLQEIFSNEMAKVDDSFFHRLEE

SFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASG

VDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILR

VNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGS
```

-continued

```
IPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKH

SLLYEYFTVYNELTKVKYVTEGMRKPAFLSGEQKKAIVDLLFKTNRKVTVK

QLKEDYFKKIECFDSVETSGVEDRFNASLGTYHDLLKIIKDKDFLDNEENE

DILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSG

QGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQ

NGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARK

KDWDPKKYGGFVSPTVAYSVLVVAKVEKGKSKKLKSVKELLGITIMERSSF

EKNPIDFLEAKGYKEVKKDLIIKLPKYSLFELENGRKRMLASARELQKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYF

DTTIDRKQYRSTKEVLDATLIHQSITGLYETRIDLSQLGGD
```

In another particular embodiment, the Cas9 variant having expanded PAM capabilities is SpCas9 (H840A) VRER, having the following amino acid sequence (with the V, R, E, R substitutions relative to the SpCas9 (1H840A) of SEQ ID NO: 194 are shown in bold underline. In addition, the methionine residue in SpCas9 (1H840) was removed for SpCas9 (H840A) VRER):

```
                                        (SEQ ID NO: 194)
DKKYSIGLDIGTNSVGWAVITDEYKVPSKKFKVLGNTDRHSIKKNLIGALL

FDSGETAEATRLKRTARRRYTRRKNRICYLQEIFSNEMAKVDDSFFHRLEE

SFLVEEDKKHERHPIFGNIVDEVAYHEKYPTIYHLRKKLVDSTDKADLRLI

YLALAHMIKFRGHFLIEGDLNPDNSDVDKLFIQLVQTYNQLFEENPINASG

VDAKAILSARLSKSRRLENLIAQLPGEKKNGLFGNLIALSLGLTPNFKSNF

DLAEDAKLQLSKDTYDDDLDNLLAQIGDQYADLFLAAKNLSDAILLSDILR

VNTEITKAPLSASMIKRYDEHHQDLTLLKALVRQQLPEKYKEIFFDQSKNG

YAGYIDGGASQEEFYKFIKPILEKMDGTEELLVKLNREDLLRKQRTFDNGS

IPHQIHLGELHAILRRQEDFYPFLKDNREKIEKILTFRIPYYVGPLARGNS

RFAWMTRKSEETITPWNFEEVVDKGASAQSFIERMTNFDKNLPNEKVLPKH
```

-continued

```
SLLYEYFTVYNELTKVKYVTEGMRKPAFLSGEQKKAIVDLLFKTNRKVTVK

QLKEDYFKKIECFDSVETSGVEDRFNASLGTYHDLLKIIKDKDFLDNEENE

DILEDIVLTLTLFEDREMIEERLKTYAHLFDDKVMKQLKRRRYTGWGRLSR

KLINGIRDKQSGKTILDFLKSDGFANRNFMQLIHDDSLTFKEDIQKAQVSG

QGDSLHEHIANLAGSPAIKKGILQTVKVVDELVKVMGRHKPENIVIEMARE

NQTTQKGQKNSRERMKRIEEGIKELGSQILKEHPVENTQLQNEKLYLYYLQ

NGRDMYVDQELDINRLSDYDVDAIVPQSFLKDDSIDNKVLTRSDKNRGKSD

NVPSEEVVKKMKNYWRQLLNAKLITQRKFDNLTKAERGGLSELDKAGFIKR

QLVETRQITKHVAQILDSRMNTKYDENDKLIREVKVITLKSKLVSDFRKDF

QFYKVREINNYHHAHDAYLNAVVGTALIKKYPKLESEFVYGDYKVYDVRKM

IAKSEQEIGKATAKYFFYSNIMNFFKTEITLANGEIRKRPLIETNGETGEI

VWDKGRDFATVRKVLSMPQVNIVKKTEVQTGGFSKESILPKRNSDKLIARK

KDWDPKKYGGFVSPTVAYSVLVVAKVEKGKSKKLKSVKELLGITIMERSSF

EKNPIDFLEAKGYKEVKKDLIIKLPKYSLFELENGRKRMLASARELQKGNE

LALPSKYVNFLYLASHYEKLKGSPEDNEQKQLFVEQHKHYLDEIIEQISEF

SKRVILADANLDKVLSAYNKHRDKPIREQAENIIHLFTLTNLGAPAAFKYF

DTTIDRKEYRSTKEVLDATLIHQSITGLYETRIDLSQLGGD
```

In addition, any available methods may be utilized to obtain or construct a variant or mutant Cas9 protein. The term "mutation," as used herein, refers to a substitution of a residue within a sequence, e.g., a nucleic acid or amino acid sequence, with another residue, or a deletion or insertion of one or more residues within a sequence. Mutations are typically described herein by identifying the original residue followed by the position of the residue within the sequence and by the identity of the newly substituted residue. Various methods for making the amino acid substitutions (mutations) provided herein are well known in the art, and are provided by, for example, Green and Sambrook, Molecular Cloning: A Laboratory Manual (4th ed., Cold Spring Harbor Laboratory Press, Cold Spring Harbor, N.Y. (2012)). Mutations can include a variety of categories, such as single base polymorphisms, microduplication regions, indel, and inversions, and is not meant to be limiting in any way. Mutations can include "loss-of-function" mutations which is the normal result of a mutation that reduces or abolishes a protein activity. Most loss-of-function mutations are recessive, because in a heterozygote the second chromosome copy carries an unmutated version of the gene coding for a fully functional protein whose presence compensates for the effect of the mutation. Mutations also embrace "gain-of-function" mutations, which is one which confers an abnormal activity on a protein or cell that is otherwise not present in a normal condition. Many gain-of-function mutations are in regulatory sequences rather than in coding regions, and can therefore have a number of consequences. For example, a mutation might lead to one or more genes being expressed in the wrong tissues, these tissues gaining functions that they normally lack. Because of their nature, gain-of-function mutations are usually dominant.

Mutations can be introduced into a reference Cas9 protein using site-directed mutagenesis. Older methods of site-directed mutagenesis known in the art rely on sub-cloning of the sequence to be mutated into a vector, such as an M13 bacteriophage vector, that allows the isolation of single-stranded DNA template. In these methods, one anneals a mutagenic primer (i.e., a primer capable of annealing to the site to be mutated but bearing one or more mismatched nucleotides at the site to be mutated) to the single-stranded template and then polymerizes the complement of the template starting from the 3' end of the mutagenic primer. The resulting duplexes are then transformed into host bacteria and plaques are screened for the desired mutation. More recently, site-directed mutagenesis has employed PCR methodologies, which have the advantage of not requiring a single-stranded template. In addition, methods have been developed that do not require sub-cloning. Several issues must be considered when PCR-based site-directed mutagenesis is performed. First, in these methods it is desirable to reduce the number of PCR cycles to prevent expansion of undesired mutations introduced by the polymerase. Second, a selection must be employed in order to reduce the number of non-mutated parental molecules persisting in the reaction. Third, an extended-length PCR method is preferred in order to allow the use of a single PCR primer set. And fourth, because of the non-template-dependent terminal extension activity of some thermostable polymerases it is often necessary to incorporate an end-polishing step into the procedure prior to blunt-end ligation of the PCR-generated mutant product.

Any of the references noted above which relate to napDNAbp domains are hereby incorporated by reference in their entireties, if not already stated so.

Exemplary Fusion Proteins

Some aspects of the disclosure provide fusion proteins comprising a napDNAbp domain (e.g. an nCas9 domain) and an adenosine deaminase domain. The adenosine deaminase domain may comprise a single deaminase enzyme, two deaminase enzymes, or more than two deaminase enzymes. In some embodiments, the adenosine deaminase domain comprises a single adenosine deaminase enzyme. In some embodiments, the adenosine deaminase domain comprises two adenosine deaminases, e.g., a heterodimer of adenosine deaminases. In still other embodiments, the fusion protein is an ancestrally reconstructed adenine base editor.

The present disclosure provides three newly discovered mutations to TadA 7.10 (SEQ ID NO: 96) (the TadA* used in ABEmax) that yield an adenosine deaminase mutant that, when connected to catalytically inactive TadA (e.g. TadA (E59A)) within the adenosine deaminase domain of a fusion protein, confer reduced off-target effects. These three mutations comprise substitutions at amino acid residues R47, V106, and N108. The fusion proteins of the present disclosure comprise one or more adenosine deaminases having at least one amino acid substitution at R47, V106, or N108. In other embodiments, the fusion proteins may comprise one or more adenosine deaminases having two or more such substitutions in combination. In some embodiments, the fusion proteins comprise adenosine deaminases comprising comprises a sequence with at least 80%, 85%, 90%, 95%, 98%, 99%, or 99.5% sequence identity to SEQ ID NO: 96 (TadA 7.10), wherein any sequence variation may only occur in amino acid positions other than R47, V106, or N108 of SEQ ID NO: 96. In other words, these fusion protein embodiments must contain amino acid substitutions at R47, V106, or N108 of SEQ ID NO: 96.

It should be appreciated that these three mutations (i.e., R47, V106, or N108 of SEQ ID NO: 96) may be introduced into other adenosine deaminases, such as *S. aureus* TadA (saTadA), or other adenosine deaminases (e.g., bacterial adenosine deaminases), such as those sequences provided below. It would be apparent to the skilled artisan how to identify amino acid residues from other adenosine deaminases that are homologous to the mutated residues in TadA 7.10. Thus, any of the mutations identified in TadA 7.10 may be made in other adenosine deaminases that have homologous amino acid residues.

In particular embodiments, any of the fusion proteins of the disclosure comprise the sequence of SEQ ID NO: 217 or SEQ ID NO: 216. In other embodiments, any of the fusion proteins of the disclosure comprise the sequence of SEQ ID NO: 221. In other embodiments, any of the fusion proteins of the disclosure comprise a sequence selected from SEQ ID NOs: 222-225. In other embodiments, any of the fusion proteins of the disclosure comprises the sequence of SEQ ID NO: 226. In other embodiments, any of the fusion proteins of the disclosure comprise the sequence of SEQ ID NOs: 227 or 228.

Exemplary fusion proteins comprise sequences that are at least least 85%, at least 90%, at least 95%, at least 98%, at least 99%, or at least 99.5% identical to the following amino acid sequences (for the purposes of clarity, the adenosine deaminase domain is shown in Bold; mutations of the ecTadA deaminase domain are shown in Bold underlining; the XTEN linker is shown in italics; and NLS is shown in underlined italics):

ABEmax, or ABE7.10

(SEQ ID NO: 215)

MSEVEFSHEYWMRHALTLAKRAWDEREVPVGAVLVHNNRVIGEGWNRPIGR

HDPTAHAEIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QTSEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

-continued

ABEmax(TadA E59A)

(SEQ ID NO: 216)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*V106W) [ABEmaxAW]

(SEQ ID NO: 217)

*MSEVEFSHEYWMRHALTLAKRAWDEREVPVGAVLVHNNRVIGEGWNRPIGRHDPTAHAA*

*IMALRQGGLVMQNYRLIDATLYVTLEPCVMCAGAMIHSRIGRVVFGARDAKTGAAGSLMD*

*VLHHPGMNHRVEITEGILADECAALLSDFFRMRRQEIKAQKKAQSSTDSGGSSGGSSGSET*

*PGTSESATPESSGGSSGGSSEVEFSHEYWMRHALTLAKRARDEREVPVGAVLVLNNRVIGE*

*GWNRAIGLHDPTAHAEIMALRQGGLVMQNYRLIDATLYVTFEPCVMCAGAMIHSRIGRVV*

*FGWRNAKTGAAGSLMDVLHYPGMNHRVEITEGILADECAALLCYFFRMPRQVFNAQKKA*

-continued

*QSSTDSGGSSGGSSGSETPGTSESATPESSGGSSGGSDKKYSIGLAIGTNSVGWAVITDEYKV*

*PSKKFKVLGNTDRHSIKKNLIGALLFDSGETAEATRLKRTARRRYTRRKNRICYLQEIFSNE*

*MAKVDDSFFHRLEESFLVEEDKKHERHPIFGNIVDEVAYHEKYPTIYHLRKKLVDSTDKA*

*DLRLIYLALAHMIKFRGHFLIEGDLNPDNSDVDKLFIQLVQTYNQLFEENPINASGVDAKAI*

*LSARLSKSRRLENLIAQLPGEKKNGLFGNLIALSLGLTPNFKSNFDLAEDAKLQLSKDTYD*

*DDLDNLLAQIGDQYADLFLAAKNLSDAILLSDILRVNTEITKAPLSASMIKRYDEHHQDLTL*

*LKALVRQQLPEKYKEIFFDQSKNGYAGYIDGGASQEEFYKFIKPILEKMDGTEELLVKLNR*

*EDLLRKQRTFDNGSIPHQIHLGELHAILRRQEDFYPFLKDNREKIEKILTFRIPYYVGPLAR*

*GNSRFAWMTRKSEETITPWNFEEVVDKGASAQSFIERMTNFDKNLPNEKVLPKHSLLYEY*

*FTVYNELTKVKYVTEGMRKPAFLSGEQKKAIVDLLFKTNRKVTVKQLKEDYFKKIECFDSV*

*EISGVEDRFNASLGTYHDLLKIIKDKDFLDNEENEDILEDIVLTLTLFEDREMIEERLKTYA*

*HLFDDKVMKQLKRRRYTGWGRLSRKLINGIRDKQSGKTILDFLKSDGFANRNFMQLIHD*

*DSLTFKEDIQKAQVSGQGDSLHEHIANLAGSPAIKKGILQTVKVVDELVKVMGRHKPENIV*

*IEMARENQTTQKGQKNSRERMKRIEEGIKELGSQILKEHPVENTQLQNEKLYLYYLQNGR*

*DMYVDQELDINRLSDYDVDHIVPQSFLKDDSIDNKVLTRSDKNRGKSDNVPSEEVVKKMK*

*NYWRQLLNAKLITQRKFDNLTKAERGGLSELDKAGFIKRQLVETRQITKHVAQILDSRMNT*

*KYDENDKLIREVKVITLKSKLVSDFRKDFQFYKVREINNYHHAHDAYLNAVVGTALIKKYP*

*KLESEFVYGDYKVYDVRKMIAKSEQEIGKATAKYFFYSNIMNFFKTEITLANGEIRKRPLIET*

*NGETGEIVWDKGRDFATVRKVLSMPQVNIVKKTEVQTGGFSKESILPKRNSDKLIARKKD*

*WDPKKYGGFDSPTVAYSVLVVAKVEKGKSKKLKSVKELLGITIMERSSFEKNPIDFLEAKG*

*YKEVKKDLIIKLPKYSLFELENGRKRMLASAGELQKGNELALPSKYVNFLYLASHYEKLKG*

*SPEDNEQKQLFVEQHKHYLDEIIEQISEFSKRVILADANLDKVLSAYNKHRDKPIREQAENI*

*IHLFTLTNLGAPAAFKYFDTTIDRKRYTSTKEVLDATLIHQSITGLYETRIDLSQLGGDSG*

*GSPKKKRKV*

ABEmax(TadA E59A, TadA*V106Q)

(SEQ ID NO: 218)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGQRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

-continued

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*V106F)

(SEQ ID NO: 219)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGFRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

-continued

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QTSEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadAE59A,TadA*V106M)

(SEQ ID NO: 220)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGMRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

-continued

SAGELQKGNELALPSKYVNFLYLASHYEKLKGSPEDNEQKQLFVEQHKHYLDEIIE

QTSEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*N108W)

(SEQ ID NO: 221)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNRAIGLHDPTAHAEIMALRQ

GGLVMQNYRLIDATLYVTFEPCVMCAGAMIHSRIGRVVFGVRWAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*R47Q)

(SEQ ID NO: 222)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

-continued

HALTLAKRARDEREVPVGAVLVLNNRVIGEGWNQAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*R47F)

(SEQ ID NO: 223)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNFAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

-continued

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*R47W)

(SEQ ID NO: 224)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNWAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

-continued

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QTSEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*R47M)

(SEQ ID NO: 225)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNMAIGLHDPTAHAEIMALRQ

GGLVMQNYRLIDATLYVTFEPCVMCAGAMIHSRIGRVVFGVRNAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

-continued

FKTEITLANGEIRKRPLIETNGETGEIVWDKGRDFATVRKVLSMPQVNIVKKTEVQT
GGFSKESILPKRNSDKLIARKKDWDPKKYGGFDSPTVAYSVLVVAKVEKGKSKKL
KSVKELLGITIMERSSFEKNPIDFLEAKGYKEVKKDLIIKLPKYSLFELENGRKRMLA
SAGELQKGNELALPSKYVNFLYLASHYEKLKGSPEDNEQKQLFVEQHKHYLDEIIE
QTSEFSKRVILADANLDKVLSAYNKHRDKPIREQAENIIHLFTLTNLGAPAAFKYFDT
TIDRKRYTSTKEVLDATLIHQSITGLYETRIDLSQLGGDSGGS*PKKKRKV*

ABEmax(TadA E59Q, TadA*V106W) [ABEmaxQW]

(SEQ ID NO: 226)

MSEVEFSHEYWMRHALTLAKRAWDEREVPVGAVLVHNNRVIGEGWNRPIGR
HDPTAHAQIMALRQGGLVMQNYRLIDATLYVTLEPCVMCAGAMIHSRIGRVV
FGARDAKTGAAGSLMDVLHHPGMNHRVEITEGILADECAALLSDFFRMRRQE
IKAQKKAQSSTDSGGSSGGS*SGSETPGTSESATPESS*GGSSGGSSEVEFSHEYWMR
HALTLAKRARDEREVPVGAVLVLNNRVIGEGWNRAIGLHDPTAHAEIMALRQ
GGLVMQNYRLIDATLYVTFEPCVMCAGAMIHSRIGRVVFGWRNAKTGAAGSL
MDVLHYPGMNHRVEITEGILADECAALLCYFFRMPRQVFNAQKKAQSSTDSG
GSSGGS*SGSETPGTSESATPESS*GGSSGGSDKKYSIGLAIGTNSVGWAVITDEYKVPS
KKFKVLGNTDRHSIKKNLIGALLFDSGETAEATRLKRTARRRYTRRKNRICYLQEIF
SNEMAKVDDSFFHRLEESFLVEEDKKHERHPIFGNIVDEVAYHEKYPTIYHLRKKLV
DSTDKADLRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTPNFKSNFDL
AEDAKLQLSKDTYDDDLDNLLAQIGDQYADLFLAAKNLSDAILLSDILRVNTEITK
APLSASMIKRYDEHHQDLTLLKALVRQQLPEKYKEIFFDQSKNGYAGYIDGGASQE
EFYKFIKPILEKMDGTEELLVKLNREDLLRKQRTFDNGSIPHQIHLGELHAILRRQED
FYPFLKDNREKIEKILTFRIPYYVGPLARGNSRFAWMTRKSEETITPWNFEEVVDKG
ASAQSFIERMTNFDKNLPNEKVLPKHSLLYEYFTVYNELTKVKYVTEGMRKPAFLS
GEQKKAIVDLLFKTNRKVTVKQLKEDYFKKIECFDSVEISGVEDRFNASLGTYHDL
LKIIKDKDFLDNEENEDILEDIVLTLTLFEDREMIEERLKTYAHLFDDKVMKQLKRR
RYTGWGRLSRKLINGIRDKQSGKTILDFLKSDGFANRNFMQLIHDDSLTFKEDIQKA
QVSGQGDSLHEHIANLAGSPAIKKGILQTVKVVDELVKVMGRHKPENIVIEMAREN
QTTQKGQKNSRERMKRIEEGIKELGSQILKEHPVENTQLQNEKLYLYYLQNGRDM
YVDQELDINRLSDYDVDHIVPQSFLKDDSIDNKVLTRSDKNRGKSDNVPSEEVVKK
MKNYWRQLLNAKLITQRKFDNLTKAERGGLSELDKAGFIKRQLVETRQITKHVAQI
LDSRMNTKYDENDKLIREVKVITLKSKLVSDFRKDFQFYKVREINNYHHAHDAYL
NAVVGTALIKKYPKLESEFVYGDYKVYDVRKMIAKSEQEIGKATAKYFFYSNIMNF
FKTEITLANGEIRKRPLIETNGETGEIVWDKGRDFATVRKVLSMPQVNIVKKTEVQT
GGFSKESILPKRNSDKLIARKKDWDPKKYGGFDSPTVAYSVLVVAKVEKGKSKKL
KSVKELLGITIMERSSFEKNPIDFLEAKGYKEVKKDLIIKLPKYSLFELENGRKRMLA
SAGELQKGNELALPSKYVNFLYLASHYEKLKGSPEDNEQKQLFVEQHKHYLDEIIE
QTSEFSKRVILADANLDKVLSAYNKHRDKPIREQAENIIHLFTLTNLGAPAAFKYFDT
TIDRKRYTSTKEVLDATLIHQSITGLYETRIDLSQLGGDSGGS*PKKKRKV*

-continued

ABEmax(TadA E59A, TadA*N108W, R47Q)

(SEQ ID NO: 227)

MSEVEFSHEYWMRHALTLAKRAWDEREVPVGAVLVHNNRVIGEGWNRPIGR

HDPTAHAAIMALRQGGLVMQNYRLIDATLYVTLEPCVMCAGAMIHSRIGRVV

FGARDAKTGAAGSLMDVLHHPGMNHRVEITEGILADECAALLSDFFRMRRQE

IKAQKKAQSSTDSGGSSGGS*SGSETPGTSESATPESS*GGSSGGSSEVEFSHEYWMR

HALTLAKRARDEREVPVGAVLVLNNRVIGEGWNQAIGLHDPTAHAEIMALRQ

GGLVMQNYRLIDATLYVTFEPCVMCAGAMIHSRIGRVVFGWRWAKTGAAGSL

MDVLHYPGMNHRVEITEGILADECAALLCYFFRMPRQVFNAQKKAQSSTDSG

GSSGGS*SGSETPGTSESATPESS*GGSSGGSDKKYSIGLAIGTNSVGWAVITDEYKVPS

KKFKVLGNTDRHSIKKNLIGALLFDSGETAEATRLKRTARRRYTRRKNRICYLQEIF

SNEMAKVDDSFFHRLEESFLVEEDKKHERHPIFGNIVDEVAYHEKYPTIYHLRKKLV

DSTDKADLRLIYLALAHMIKFRGHFLIEGDLNPDNSDVDKLFIQLVQTYNQLFEENP

INASGVDAKAILSARLSKSRRLENLIAQLPGEKKNGLFGNLIALSLGLTPNFKSNFDL

AEDAKLQLSKDTYDDDLDNLLAQIGDQYADLFLAAKNLSDAILLSDILRVNTEITK

APLSASMIKRYDEHHQDLTLLKALVRQQLPEKYKEIFFDQSKNGYAGYIDGGASQE

EFYKFIKPILEKMDGTEELLVKLNREDLLRKQRTFDNGSIPHQIHLGELHAILRRQED

FYPFLKDNREKIEKILTFRIPYYVGPLARGNSRFAWMTRKSEETITPWNFEEVVDKG

ASAQSFIERMTNFDKNLPNEKVLPKHSLLYEYFTVYNELTKVKYVTEGMRKPAFLS

GEQKKAIVDLLFKTNRKVTVKQLKEDYFKKIECFDSVEISGVEDRFNASLGTYHDL

LKIIKDKDFLDNEENEDILEDIVLTLTLFEDREMIEERLKTYAHLFDDKVMKQLKRR

RYTGWGRLSRKLINGIRDKQSGKTILDFLKSDGFANRNFMQLIHDDSLTFKEDIQKA

QVSGQGDSLHEHIANLAGSPAIKKGILQTVKVVDELVKVMGRHKPENIVIEMAREN

QTTQKGQKNSRERMKRIEEGIKELGSQILKEHPVENTQLQNEKLYLYYLQNGRDM

YVDQELDINRLSDYDVDHIVPQSFLKDDSIDNKVLTRSDKNRGKSDNVPSEEVVKK

MKNYWRQLLNAKLITQRKFDNLTKAERGGLSELDKAGFIKRQLVETRQITKHVAQI

LDSRMNTKYDENDKLIREVKVITLKSKLVSDFRKDFQFYKVREINNYHHAHDAYL

NAVVGTALIKKYPKLESEFVYGDYKVYDVRKMIAKSEQEIGKATAKYFFYSNIMNF

FKTEITLANGEIRKRPLIETNGETGEIVWDKGRDFATVRKVLSMPQVNIVKKTEVQT

GGFSKESILPKRNSDKLIARKKDWDPKKYGGFDSPTVAYSVLVVAKVEKGKSKKL

KSVKELLGITIMERSSFEKNPIDFLEAKGYKEVKKDLIIKLPKYSLFELENGRKRMLA

SAGELQKGNELALPSKYVNFLYLASHYEKLKGSPEDNEQKQLFVEQHKHYLDEIIE

QISEFSKRVILADANLDKVLSAYNKHRDKPIREQAENIIHLFTLTNLGAPAAFKYFDT

TIDRKRYTSTKEVLDATLIHQSITGLYETRIDLSQLGGDSGGS*PKKKRKV*

ABEmax(TadA E59A, TadA*V106W, R47Q)

(SEQ ID NO: 228)

MSEVEFSHEYWMRHALTLAKRAWDEREVPVGAVLVHNNRVIGEGWNRPIGRH

DPTAHAAIMALRQGGLVMQNYRLIDATLYVTLEPCVMCAGAMIHSRIGRVVFG

ARDAKTGAAGSLMDVLHHPGMNHRVEITEGILADECAALLSDFFRMRRQEIKA

QKKAQSSTD*SGGSSGGSSGSETPGTSESATPESSGGS*SEVEFSHEYWMRHALTL

AKRARDEREVPVGAVLVLNNRVIGEGWNQAIGLHDPTAHAEIMALRQGGLVM

QNYRLIDATLYVTFEPCVMCAGAMIHSRIGRVVFGWRWAKTGAAGSLMDVLHY

PGMNHRVEITEGILADECAALLCYFFRMPRQVFNAQKKAQSSTD*SGGSSGGSSGS*

-continued

```
ETPGTSESATPESSGGSSGGSDKKYSIGLAIGTNSVGWAVITDEYKVPSKKFKVLGNTD

RHSIKKNLIGALLFDSGETAEATRLKRTARRRYTRRKNRICYLQEIFSNEMAKVDDSF

FHRLEESFLVEEDKKHERHPIFGNIVDEVAYHEKYPTIYHLRKKLVDSTDKADLRLIY

LALAHMIKFRGHFLIEGDLNPDNSDVDKLFIQLVQTYNQLFEENPINASGVDAKAILS

ARLSKSRRLENLIAQLPGEKKNGLFGNLIALSLGLTPNFKSNFDLAEDAKLQLSKDTY

DDDLDNLLAQIGDQYADLFLAAKNLSDAILLSDILRVNTEITKAPLSASMIKRYDEHH

QDLTLLKALVRQQLPEKYKEIFFDQSKNGYAGYIDGGASQEEFYKFIKPILEKMDGTE

ELLVKLNREDLLRKQRTFDNGSIPHQIHLGELHAILRRQEDFYPFLKDNREKIEKILTF

RIPYYVGPLARGNSRFAWMTRKSEETITPWNFEEVVDKGASAQSFIERMTNFDKNLP

NEKVLPKHSLLYEYFTVYNELTKVKYVTEGMRKPAFLSGEQKKAIVDLLFKTNRKV

TVKQLKEDYFKKIECFDSVEISGVEDRFNASLGTYHDLLKIIKDKDFLDNEENEDILED

IVLTLTLFEDREMIEERLKTYAHLFDDKVMKQLKRRRYTGWGRLSRKLINGIRDKQS

GKTILDFLKSDGFANRNFMQLIHDDSLTFKEDIQKAQVSGQGDSLHEHIANLAGSPAI

KKGILQTVKVVDELVKVMGRHKPENIVIEMARENQTTQKGQKNSRERMKRIEEGIK

ELGSQILKEHPVENTQLQNEKLYLYYLQNGRDMYVDQELDINRLSDYDVDHIVPQSF

LKDDSIDNKVLTRSDKNRGKSDNVPSEEVVKKMKNYWRQLLNAKLITQRKFDNLTK

AERGGLSELDKAGFIKRQLVETRQITKHVAQILDSRMNTKYDENDKLIREVKVITLKS

KLVSDFRKDFQFYKVREINNYHHAHDAYLNAVVGTALIKKYPKLESEFVYGDYKVY

DVRKMIAKSEQEIGKATAKYFFYSNIMNFFKTEITLANGEIRKRPLIETNGETGEIVWD

KGRDFATVRKVLSMPQVNIVKKTEVQTGGFSKESILPKRNSDKLIARKKDWDPKKY

GGFDSPTVAYSVLVVAKVEKGKSKKLKSVKELLGITIMERSSFEKNPIDFLEAKGYKE

VKKDLIIKLPKYSLFELENGRKRMLASAGELQKGNELALPSKYVNFLYLASHYEKLK

GSPEDNEQKQLFVEQHKHYLDEIIEQISEFSKRVILADANLDKVLSAYNKHRDKPIRE

QAENIIHLFTLTNLGAPAAFKYFDTTIDRKRYTSTKEVLDATLIHQSITGLYETRIDL

SQLGGDSGGSPKKKRKV
```

Fusion Protein Architectures

As provided above, exemplary aspects of the disclosure provide fusion proteins comprising a Cas9 domain and an adenosine deaminase domain. The Cas9 domain may be any of the Cas9 domains or Cas9 proteins (e.g., dCas9 or nCas9) provided herein. In some embodiments, any of the Cas9 domains or Cas9 proteins (e.g., dCas9 or nCas9) provided herein may be fused with any of the adenosine deaminases provided herein. In some embodiments, the adenosine deaminase domain comprises a single adenosine deaminase enzyme. In other embodiments, the adenosine deaminase domain comprises two adenosine deaminases, e.g., a heterodimer of adenosine deaminases.

In some embodiments, the fusion proteins comprising adenosine deaminases and a napDNAbp (e.g., Cas9 domain) do not include a linker sequence. In some embodiments, a linker is present between the adenosine deaminases and/or between an adenosine deaminase and the napDNAbp. In some embodiments, the "]-[" used in the general architecture above indicates the presence of an optional linker. In some embodiments, an adenosine deaminase and the napDNAbp are fused via any of the linkers provided herein, and the adenosine deaminases are fused to each other via any of the linkers provided herein. For example, in some embodiments the adenosine deaminases and the napDNAbp are fused via any of the linkers provided below in the section entitled "Linkers".

In some embodiments, the fusion proteins provided herein further comprise one or more nuclear targeting sequences, for example, a nuclear localization sequence (NLS). In some embodiments, a NLS comprises an amino acid sequence that facilitates the importation of a protein, that comprises an NLS, into the cell nucleus (e.g., by nuclear transport). In some embodiments, any of the fusion proteins provided herein further comprise a nuclear localization sequence (NLS). In certain embodiments, any of the base editors comprise two NLSs. In some embodiments, one or more of the NLSs are bipartite NLSs ("bpNLS"). In certain embodiments, the disclosed base editors comprise two bipartite NLSs. In some embodiments, the disclosed base editors comprise more than two bipartite NLSs.

In some embodiments, the NLS is fused to the N-terminus of the fusion protein. In some embodiments, the NLS is fused to the C-terminus of the fusion protein. In some embodiments, the NLS is fused to the C-terminus of the napDNAbp. In some embodiments, the NLS is fused to the N-terminus of the adenosine deaminase. In some embodiments, the NLS is fused to the C-terminus of the adenosine deaminase. In some embodiments, the NLS is fused to the fusion protein via one or more linkers. In some embodiments, the NLS is fused to the fusion protein without a linker. In some embodiments, the NLS comprises an amino acid sequence of any one of the NLS sequences provided or referenced herein. In some embodiments, the NLS comprises an amino acid sequence as set forth in SEQ ID NO: 117 or SEQ ID NO: 118. In some embodiments, the NLS comprises an amino acid sequence as set forth in SEQ ID NO: 114 or SEQ ID NO: 115. Additional nuclear localization sequences are known in the art and would be apparent to the skilled artisan. For example, NLS sequences are described in Plank et al., PCT/EP2000/011690, the contents of which are incorporated herein by reference for their disclosure of exemplary nuclear localization sequences. In some embodiments, a NLS comprises the amino acid sequence PKKKRKV (SEQ ID NO: 117), MDSLLMNRRKFLYQFKNVRWAKGRRETYLC (SEQ ID NO: 118), KRTADGSEFESPKKKRKV (SEQ ID NO: 114), or KRTADGSEFEPKKKRKV (SEQ ID NO: 115).

In some embodiments, the fusion proteins provided herein do not comprise a linker. In some embodiments, a linker is present between one or more of the domains or proteins (e.g., adenosine deaminase, napDNAbp, and/or NLS). In some embodiments, the "]-[" used in the general architecture above indicates the presence of an optional linker.

In some embodiments, the general architecture of exemplary fusion proteins with a first adenosine deaminase, a second adenosine deaminase, and a napDNAbp comprises any one of the following structures, where NLS is a nuclear localization sequence (e.g., any NLS provided herein), $NH_2$ is the N-terminus of the fusion protein, and COOH is the C-terminus of the fusion protein.

In some embodiments, the general architecture of exemplary fusion proteins comprising a first adenosine deaminase, a second adenosine deaminase, and a napDNAbp.

$NH_2$-[first adenosine deaminase]-[second adenosine deaminase]-[napDNAbp]-COOH;

$NH_2$-[first adenosine deaminase]-[napDNAbp]-[second adenosine deaminase]-COOH;

$NH_2$-[napDNAbp]-[first adenosine deaminase]-[second adenosine deaminase]-COOH;

$NH_2$-[second adenosine deaminase]-[first adenosine deaminase]-[napDNAbp]-COOH;

$NH_2$-[second adenosine deaminase]-[napDNAbp]-[first adenosine deaminase]-COOH;

$NH_2$-[napDNAbp]-[second adenosine deaminase]-[first adenosine deaminase]-COOH;

In particular embodiments, the disclosure provides a fusion protein comprising the architecture $NH_2$-[first adenosine deaminase]-[second adenosine deaminase]-[napDNAbp]-[NLS]-COOH.

Exemplary fusion proteins comprising a first adenosine deaminase, a second adenosine deaminase, a napDNAbp, and an NLS, where NLS is a nuclear localization sequence (e.g., any NLS provided herein).

$NH_2$-[NLS]-[first adenosine deaminase]-[second adenosine deaminase]-[napDNAbp]-COOH;

$NH_2$-[first adenosine deaminase]-[NLS]-[second adenosine deaminase]-[napDNAbp]-COOH;

$NH_2$-[first adenosine deaminase]-[second adenosine deaminase]-[NLS]-[napDNAbp]-COOH;

$NH_2$-[first adenosine deaminase]-[second adenosine deaminase]-[napDNAbp]-[NLS]-COOH;

$NH_2$-[NLS]-[first adenosine deaminase]-[napDNAbp]-[second adenosine deaminase]-COOH;

$NH_2$-[first adenosine deaminase]-[NLS]-[napDNAbp]-[second adenosine deaminase]-COOH;

$NH_2$-[first adenosine deaminase]-[napDNAbp]-[NLS]-[second adenosine deaminase]-COOH;

$NH_2$-[first adenosine deaminase]-[napDNAbp]-[second adenosine deaminase]-[NLS]-COOH;

$NH_2$-[NLS]-[napDNAbp]-[first adenosine deaminase]-[second adenosine deaminase]-COOH;

$NH_2$-[napDNAbp]-[NLS]-[first adenosine deaminase]-[second adenosine deaminase]-COOH;

$NH_2$-[napDNAbp]-[first adenosine deaminase]-[NLS]-[second adenosine deaminase]-COOH;

$NH_2$-[napDNAbp]-[first adenosine deaminase]-[second adenosine deaminase]-[NLS]-COOH;

$NH_2$-[NLS]-[second adenosine deaminase]-[first adenosine deaminase]-[napDNAbp]-COOH;

$NH_2$-[second adenosine deaminase]-[NLS]-[first adenosine deaminase]-[napDNAbp]-COOH;

$NH_2$-[second adenosine deaminase]-[first adenosine deaminase]-[NLS]-[napDNAbp]-COOH;

$NH_2$-[second adenosine deaminase]-[first adenosine deaminase]-[napDNAbp]-[NLS]-COOH;

$NH_2$-[NLS]-[second adenosine deaminase]-[napDNAbp]-[first adenosine deaminase]-COOH;

$NH_2$-[second adenosine deaminase]-[NLS]-[napDNAbp]-[first adenosine deaminase]-COOH;

$NH_2$-[second adenosine deaminase]-[napDNAbp]-[NLS]-[first adenosine deaminase]-COOH;

$NH_2$-[second adenosine deaminase]-[napDNAbp]-[first adenosine deaminase]-[NLS]-COOH;

$NH_2$-[NLS]-[napDNAbp]-[second adenosine deaminase]-[first adenosine deaminase]-COOH;

$NH_2$-[napDNAbp]-[NLS]-[second adenosine deaminase]-[first adenosine deaminase]-COOH;

$NH_2$-[napDNAbp]-[second adenosine deaminase]-[NLS]-[first adenosine deaminase]-COOH; or $NH_2$-[napDNAbp]-[second adenosine deaminase]-[first adenosine deaminase]-[NLS]-COOH.

In some embodiments, the fusion proteins provided herein do not comprise a linker. In some embodiments, a linker is present between one or more of the domains or proteins (e.g., first adenosine deaminase, second adenosine deaminase, napDNAbp, and/or NLS). In some embodiments, the "]-[" used in the general architecture above indicates the presence of an optional linker.

It should be appreciated that the fusion proteins of the present disclosure may comprise one or more additional domains, such as one or more hetereologous protein domains (e.g., about or more than about 1, 2, 3, 4, 5, 6, 7, 8, 9, 10, or more domains in addition to the base editor components). A disclosed fusion protein may comprise any additional protein sequence, and optionally a linker sequence between any two domains. Other exemplary features that may be present are localization sequences, such as cytoplasmic localization sequences, export sequences, such as nuclear export sequences, or other localization sequences, as well as sequence tags that are useful for solubilization, purification, or detection of the fusion proteins.

Examples of protein domains that may be fused to a base editor or component thereof (e.g., the napDNAbp domain, the nucleobase modification domain, or the NLS domain) include, without limitation, epitope tags, and reporter gene sequences. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-5-transferase (GST), horseradish peroxidase (HRP), chloramphenicol acetyltransferase (CAT), beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A base editor may be fused to a gene sequence encoding a protein or a fragment of a protein that bind DNA molecules or bind other cellular molecules, including, but not limited to, maltose binding protein (MBP), S-tag, Lex A DNA binding domain (DBD) fusions, GAL4 DNA binding domain fusions, and herpes simplex virus (HSV) BP16 protein fusions. Additional domains that may form part of a base editor are described in US Patent Publication No. 2011/0059502, published Mar. 10, 2011 and incorporated herein by reference in its entirety.

In an aspect of the disclosure, a reporter gene which includes, but is not limited to, glutathione-5-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP), may be introduced into a cell to encode a gene product which serves as a marker by which to measure the alteration or modification of expression of the gene product. In certain embodiments of the disclosure the gene product is luciferase. In a further embodiment of the disclosure the expression of the gene product is decreased.

Suitable protein tags provided herein include, but are not limited to, biotin carboxylase carrier protein (BCCP) tags, myc-tags, calmodulin-tags, FLAG-tags, hemagglutinin (HA)-tags, polyhistidine tags, also referred to as histidine tags or His-tags, maltose binding protein (MBP)-tags, nus-tags, glutathione-S-transferase (GST)-tags, green fluorescent protein (GFP)-tags, thioredoxin-tags, S-tags, Softags (e.g., Softag 1, Softag 3), strep-tags, biotin ligase tags, FlAsH tags, V5 tags, and SBP-tags. Additional suitable sequences will be apparent to those of skill in the art. In some embodiments, the fusion protein comprises one or more His tags.

Linkers

In some embodiments of the disclosed adenine base editors, linkers may be used to link any of the protein or protein domains described herein. The linker may be as simple as a covalent bond, or it may be a polymeric linker many atoms in length. In certain embodiments, the linker is a polypeptide or based on amino acids. In other embodiments, the linker is not peptide-like. In certain embodiments, the linker is a covalent bond (e.g., a carbon-carbon bond, disulfide bond, carbon-heteroatom bond, etc.). In certain embodiments, the linker is a carbon-nitrogen bond of an amide linkage. In certain embodiments, the linker is a cyclic or acyclic, substituted or unsubstituted, branched or unbranched aliphatic or heteroaliphatic linker. In certain embodiments, the linker is polymeric (e.g., polyethylene, polyethylene glycol, polyamide, polyester, etc.). In certain embodiments, the linker comprises a monomer, dimer, or polymer of aminoalkanoic acid. In certain embodiments, the linker comprises an aminoalkanoic acid (e.g., glycine, ethanoic acid, alanine, beta-alanine, 3-aminopropanoic acid, 4-aminobutanoic acid, 5-pentanoic acid, etc.). In certain embodiments, the linker comprises a monomer, dimer, or polymer of aminohexanoic acid (Ahx). In certain embodiments, the linker is based on a carbocyclic moiety (e.g., cyclopentane, cyclohexane). In other embodiments, the linker comprises a polyethylene glycol moiety (PEG). In other embodiments, the linker comprises amino acids. In certain embodiments, the linker comprises a peptide. In certain embodiments, the linker comprises an aryl or heteroaryl moiety. In certain embodiments, the linker is based on a phenyl ring. The linker may include functionalized moieties to facilitate attachment of a nucleophile (e.g., thiol, amino) from the peptide to the linker. Any electrophile may be used as part of the linker. Exemplary electrophiles include, but are not limited to, activated esters, activated amides, Michael acceptors, alkyl halides, aryl halides, acyl halides, and isothiocyanates.

In some embodiments, the linker is an amino acid or a plurality of amino acids (e.g., a peptide or protein). In some embodiments, the linker is a bond (e.g., a covalent bond), an organic molecule, group, polymer, or chemical moiety. In some embodiments, the linker is 5-100 amino acids in length, for example, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35-40, 40-45, 45-50, 50-60, 60-70, 70-80, 80-90, 90-100, 100-110, 110-120, 120-130, 130-140, 140-150, or 150-200 amino acids in length. Longer or shorter linkers are also contemplated. In some embodiments, a linker comprises the amino acid sequence SGSETPGTSESATPES (SEQ ID NO: 111), which may also be referred to as the XTEN linker. In some embodiments, the linker is 32 amino acids in length. In some embodiments, the linker comprises the amino acid sequence $(SGGS)_2$—SGSETPGTSESATPES-$(SGGS)_2$ (SEQ ID NO: 112), which may also be referred to as $(SGGS)_2$—XTEN-$(SGGS)_2$ (SEQ ID NO: 112). In some embodiments, the linker comprises the amino acid sequence, wherein n is 0, 1, 2, 3, 4, 5, 6, 7, 8, 9, or 10. In some embodiments, a linker comprises the amino acid sequence SGGS (SEQ ID NO: 113). In some embodiments, a linker comprises $(SGGS)_n$(SEQ ID NO: 229), $(GGGS)_n$ (SEQ ID NO: 230), $(GGGGS)_n$ (SEQ ID NO: 231), $(G)_n$ (SEQ ID NO: 232), $(EAAAK)_n$ (SEQ ID NO: 233), $(SGGS)_n$-SGSETPGTSESATPES-$(SGGS)_n$ (SEQ ID NO: 234), $(GGS)_n$ (SEQ ID NO: 235), SGSETPGTSESATPES (SEQ ID NO: 236), or $(XP)_n$ (SEQ ID NO: 237) motif, or a combination of any of these, wherein n is independently an integer between 1 and 30, and wherein X is any amino acid. In some embodiments, n is 1, 2, 3, 4, 5, 6, 7, 8, 9, 10, 11, 12, 13, 14, or 15. In some embodiments, a linker comprises SGSETPGTSESATPES (SEQ ID NO: 236), and SGGS (SEQ ID NO: 229). In some embodiments, a linker comprises SGGSSGSETPGTSESATPESSGGS (SEQ ID NO: 238). In some embodiments, a linker comprises SGGSSGGSSGSETPGTSESATPESSGGSSGGS (SEQ ID NO: 239). In some embodiments, a linker comprises GGSGGSPGSPAGSPTSTEEGTSESATPESGPGT-STEPSEGSAPGSPAGSPTSTEEGTSTE PSEGSAPGT-STEPSEGSAPGTSESATPESGPGSEPATSGGSGGS (SEQ ID NO: 240). In some embodiments, the linker is 24 amino acids in length. In some embodiments, the linker comprises the amino acid sequence SGGSSGGSSGSETPGTSESAT-PES (SEQ ID NO: 241). In some embodiments, the linker is 40 amino acids in length. In some embodiments, the linker comprises the amino acid sequence SGGSSGGSSG-SETPGTSESATPESSGGSSGGSSGGSSGGS (SEQ ID NO: 242). In some embodiments, the linker is 64 amino acids in length. In some embodiments, the linker comprises the amino acid sequence SGGSSGGSSGSETPGTSESAT-PESSGGSSGGSSGGSSGGSSGSETPGTSESAT-PESSGGS SGGS (SEQ ID NO: 243). In some embodiments, the linker is 92 amino acids in length. In some embodiments, the linker comprises the amino acid sequence PGSPAGSPTSTEEGTSESATPESGPGT-STEPSEGSAPGSPAGSPTSTEEGTSTEPSEGSAP GTSTEPSEGSAPGTSESATPESGPGSEPATS (SEQ ID NO: 244). It should be appreciated that any of the linkers provided herein may be used to link a first adenosine deaminase and a second adenosine deaminase; an adenosine deaminase (e.g., a first or a second adenosine deaminase) and a napDNAbp; a napDNAbp and an NLS; or an adenosine deaminase (e.g., a first or a second adenosine deaminase) and an NLS.

In some embodiments, any of the fusion proteins provided herein, comprise an adenosine deaminase and a napDNAbp that are fused to each other via a linker. In some embodiments, any of the fusion proteins provided herein, comprise a first adenosine deaminase and a second adenosine deaminase that are fused to each other via a linker. In some embodiments, any of the fusion proteins provided herein, comprise an NLS, which may be fused to an adenosine deaminase (e.g., a first and/or a second adenosine deaminase) and a nucleic acid programmable DNA binding protein (napDNAbp). Various linker lengths and flexibilities between an adenosine deaminase (e.g., an engineered ecTadA) and a napDNAbp (e.g., a Cas9 domain), and/or between a first adenosine deaminase and a second adenosine deaminase may be employed (e.g., ranging from flexible linkers of the form of SEQ ID NOs: 229-245 (see, e.g., Guilinger J P, Thompson D B, Liu D R. Fusion of catalytically inactive Cas9 to FokI nuclease improves the specificity of genome modification. *Nat. Biotechnol.* 2014; 32(6): 577-82; the entire contents are incorporated herein by reference) and (XP). (SEQ ID NO: 237)) in order to achieve the optimal length for deaminase activity for the specific application. In some embodiments, n is 1, 2, 3, 4, 5, 6, 7, 8, 9, 10, 11, 12, 13, 14, or 15. In some embodiments, the linker comprises a $(GGS)_n$(SEQ ID NO: 245) motif, wherein n is 1, 3, or 7. In some embodiments, the adenosine deaminase and the napDNAbp, and/or the first adenosine deaminase and the second adenosine deaminase of any of the fusion proteins provided herein are fused via a linker comprising an amino acid sequence selected from SEQ ID NOs: 229-245. In some embodiments, the linker is 24 amino acids in length. In some embodiments, the linker is 32 amino acids in length. In some embodiments, the linker is 32 amino acids in length. In some embodiments, the linker comprises the amino acid sequence $(SGGS)_2$—SGSETPGTSESATPES-$(SGGS)_2$ (SEQ ID NO: 112), which may also be referred to as $(SGGS)_2$—XTEN-$(SGGS)_2$ (SEQ ID NO: 112). In some embodiments, the linker comprises the amino acid sequence, wherein n is 0, 1, 2, 3, 4, 5, 6, 7, 8, 9, or 10. In some embodiments, the linker is 40 amino acids in length. In some embodiments, the linker is 64 amino acids in length. In some embodiments, the linker is 92 amino acids in length.

Reduced Off-Target Effects

Reduced RNA Editing Effects

In some aspects, provided herein are adenine base editors and methods of editing DNA by contacting DNA with any of these disclosed base editors that generate (or cause) reduced off-target effects. In some embodiments, the base editors are evolved or engineered to have reduced RNA editing effects. The term "RNA editing effects," as used herein, refers to the introduction of modifications (e.g. deaminations) of nucleotides within cellular RNA, e.g., messenger RNA (mRNA). An important goal of DNA base editing efficiency is the modification (e.g. deamination) of a specific nucleotide within DNA, without introducing modifications of similar nucleotides within RNA. RNA editing effects are "low" or "reduced" when a detected mutation is introduced into RNA molecules at a frequency of 0.3% or less. RNA editing may be measured by techniques known in the art, including high-throughput screening of sequencing reads and RNA-seq. The effects of RNA editing on the function of a protein translated from the edited mRNA transcript may be predicted by use of the SIFT algorithm, which bases predictions on sequence homology and the physical properties of amino acids.

The present disclosure further provides methods of administering the disclosed adenine base editors wherein the method yields reduced off-target effects, such as low RNA editing effects. In some embodiments, the methods induce (or yield, provide or cause) an average adenosine (A) to inosine (I) (A-to-I) editing frequency in cellular mRNA transcripts of 0.3% or less. In some embodiments, the methods induce (or cause) an average adenosine (A) to inosine (I) (A-to-I) actual and/or consistent editing frequencies in RNA of about 0.3% or less. The methods may induce actual or average A-to-I editing frequencies in RNA of about 0.5% or less, 0.4% or less, 0.35% or less, 0.3% or less, 0.25% or less, 0.2% or less, 0.15% or less, 0.12% or less, 0.1% or less, 0.08% or less, 0.075% or less, 0.06% or less, 0.05% or less, 0.04% or less, or 0.01% or less. In particular embodiments, the methods and base editors used therein induce an average A-to-I editing frequency of 0.068%.

In some embodiments, the methods induce (or provide or cause) an average adenosine (A) to inosine (I) (A-to-I) editing frequency across the mRNA transcriptome of a human cell (e.g. an HEK293 cell) of about 0.2% or less. The methods may induce actual or average A-to-I transcriptome-wide editing frequencies in RNA of about 0.5% or less, 0.4% or less, 0.35% or less, 0.25% or less, 0.2% or less, 0.15% or less, 0.12% or less, 0.1% or less, 0.08% or less, 0.075% or less, 0.06% or less, 0.05% or less, 0.04% or less, or 0.01% or less. In particular embodiments, the methods induce a human mRNA transcriptome-wide average A-to-I editing frequency of 0.14%.

In some aspects, the methods induce average overall magnitudes of detectable A-to-I edits among 182 total adenosines analyzed among three mRNA transcripts of 50 edits or less. The methods may induce magnitudes of A-to-I edits in this substrate of about 40 edits or less, 35 edits or less, 30 edits or less, 25 edits or less, 20 edits or less, or 15 edits or less. In a particular embodiment, the methods induce magnitudes of 26 edits or less.

In some aspects, the methods induce average overall magnitudes of detectable A-to-I edits among the transcriptome of a human cell of 65,000 edits or less. The methods may induce magnitudes of A-to-I edits in this substrate of about 70,000 edits or less, 62,000 edits or less, 60,000 edits or less, 58,000 edits or less, 57,750 edits or less, 57,500 edits or less, 57,000 edits or less, 56,500 edits or less, 56,000 edits or less, 55,500 edits or less, 55,000 edits or less, or 54,000 edits or less. In a particular embodiment, the methods induce transcriptome-wide magnitudes of 57,700 edits or less.

Reduced Off-Target DNA Editing and Indel Frequencies

Some aspects of the disclosure are based on the recognition that any of the adenine base editors provided herein are capable of modifying a specific DNA base without generating a significant proportion of indels. An "indel", as used herein, refers to the insertion or deletion of a nucleotide base within a DNA substrate. Such insertions or deletions can lead to frame shift mutations within a coding region of a gene. In some embodiments, it is desirable to generate adenine base editors that efficiently modify (e.g. mutate or deaminate) a specific nucleotide within a DNA, without generating a large number of insertions or deletions (i.e., indels) in the nucleic acid (while at the same time having lower RNA editing effects than existing adenine base editors).

In some embodiments, a intended mutation is a mutation that is generated by a specific base editor bound to a gRNA, specifically designed to generate the intended mutation (e.g. deamination). In some embodiments, the intended mutation is a mutation associated with a disease or disorder. In some embodiments, the intended mutation is a adenine (A) to guanine (G) point mutation associated with a disease or disorder. In some embodiments, the intended mutation is a thymine (T) to cytosine (C) point mutation associated with a disease or disorder. In some embodiments, the intended mutation is a adenine (A) to guanine (G) point mutation within the coding region of a gene. In some embodiments, the intended mutation is a thymine (T) to cytosine (C) point mutation within the coding region of a gene. In some embodiments, the intended mutation is a deamination that generates a stop codon, for example, a premature stop codon within the coding region of a gene. In some embodiments, the intended mutation is a mutation that eliminates a stop codon. In some embodiments, the intended mutation eliminates a stop codon comprising the nucleic acid sequence 5'-TAG-3', 5'-TAA-3', or 5'-TGA-3'.

In some embodiments, the intended mutation is a deamination that alters the regulatory sequence of a gene (e.g., a gene promotor or gene repressor). In some embodiments, the intended mutation is a deamination introduced into the gene promoter or gene repressor. In particular embodiments, the deamination introduced into the gene promoter (or gene repressor) leads to a decrease in the transcription of a gene operably linked to the gene promoter (or gene repressor). In other embodiments, the deamination leads to an increase in the transcription of a gene operably linked to the gene promoter (or gene repressor).

In some embodiments, the intended mutation is a deamination that alters the splicing of a gene. Accordingly, in some embodiments, the intended deamination results in the introduction of a splice site in a gene. In other embodiments, the intended deamination results in the removal of a splice site.

In certain embodiments, any of the adenine base editors provided herein are capable of generating a greater proportion of intended modifications (e.g., point mutations or deaminations) versus indels. In some embodiments, the base editors provided herein are capable of generating a ratio of intended point mutations to indels that is greater than 1:1. In some embodiments, the base editors provided herein are capable of generating a ratio of intended point mutations to indels that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 200:1, at least 300:1, at least 400:1, at least 500:1, at least 600:1, at least 700:1, at least 800:1, at least 900:1, or at least 1000:1, or more. The number of intended mutations and indels may be determined using any suitable method, for example the methods used in the below Examples. In some embodiments, to calculate indel frequencies, sequencing reads are scanned for exact matches to two 10-bp sequences that flank both sides of a window in which indels might occur. If no exact matches are located, the read is excluded from analysis. If the length of this indel window exactly matches the reference sequence the read is classified as not containing an indel. If the indel window is two or more bases longer or shorter than the reference sequence, then the sequencing read is classified as an insertion or deletion, respectively.

In some embodiments, the adenine base editors provided herein are capable of limiting formation of indels in a region of a DNA substrate. In some embodiments, the region is at a nucleotide targeted by a base editor or a region within 2, 3, 4, 5, 6, 7, 8, 9, or 10 nucleotides of a nucleotide targeted by a base editor. In some embodiments, any of the base editors provided herein are capable of limiting the formation of indels at a region of a nucleic acid to less than 1%, less than 1.5%, less than 2%, less than 2.5%, less than 3%, less than 3.5%, less than 4%, less than 4.5%, less than 5%, less than 6%, less than 7%, less than 8%, less than 9%, less than 10%, less than 12%, less than 15%, or less than 20%. The number of indels formed at a nucleic acid region may depend on the amount of time a nucleic acid (e.g., a nucleic acid within the genome of a cell) is exposed to a base editor. In some embodiments, an number or proportion of indels is determined after at least 1 hour, at least 2 hours, at least 6 hours, at least 12 hours, at least 24 hours, at least 36 hours, at least 48 hours, at least 3 days, at least 4 days, at least 5 days, at least 7 days, at least 10 days, or at least 14 days of exposing a nucleic acid (e.g., a nucleic acid within the genome of a cell) to an adenine base editor.

In some embodiments, any of the base editors provided herein are capable of generating a ratio of intended mutations to unintended mutations (e.g., intended point mutations:unintended point mutations) that is greater than 1:1. In some embodiments, any of the base editors provided herein are capable of generating a ratio of intended mutations to unintended mutations (e.g., intended point mutations:unintended point mutations) that is at least 1.5:1, at least 2:1, at least 2.5:1, at least 3:1, at least 3.5:1, at least 4:1, at least 4.5:1, at least 5:1, at least 5.5:1, at least 6:1, at least 6.5:1, at least 7:1, at least 7.5:1, at least 8:1, at least 10:1, at least 12:1, at least 15:1, at least 20:1, at least 25:1, at least 30:1, at least 40:1, at least 50:1, at least 100:1, at least 150:1, at least 200:1, at least 250:1, at least 500:1, or at least 1000:1, or more. In some embodiments, the ratio of intended point mutation to indel formation is greater than 1:1, 10:1, 50:1, 100:1, 500:1, or 1000:1, or more.

Guide Sequences (e.g., Guide RNAs)

The present disclosure further provides guide RNAs for use in accordance with the disclosed methods of editing. The disclosure provides guide RNAs that are designed to recognize target sequences. Such gRNAs may be designed to have guide sequences (or "spacers") having complementarity to a protospacer within the target sequence. Guide RNAs are also provided for use with one or more of the disclosed fusion proteins, e.g., in the disclosed methods of editing a nucleic acid molecule. Such gRNAs may be designed to have guide sequences having complementarity to a protospacer within a target sequence to be edited, and to have backbone sequences that interact specifically with the napDNAbp domains of any of the disclosed base editors, such as Cas9 nickase domains of the disclosed base editors.

The disclosure further provides methods for editing a target nucleic acid molecule, e.g., a single nucleobase within a genome, with an adenine base editor described herein (e.g., in the form of an evolved base editor as described herein, or a vector or construct encoding same), e.g. editing of cellular mRNA. Such methods involve transducing (e.g., via transfection) cells with a plurality of complexes each comprising a fusion protein (e.g., a fusion protein comprising a Cas9 nickase (nCas9) domain and an adenosine deaminase domain) and a gRNA molecule. In some embodiments, the gRNA is bound to the napDNAbp domain (e.g., nCas9 domain) of the fusion protein. In some embodiments, each gRNA comprises a guide sequence of at least 10 contiguous nucleotides (e.g., 10, 11, 12, 13, 14, 15, 16, 17, 18, 19, 20, 21, 22, 23, 24, 25, 26, 27, 28, 29, or 30 contiguous nucleotides) that is complementary to a target sequence. In certain embodiments, the methods involve the transfection of nucleic acid constructs (e.g., plasmids) that each (or together) encode the components of a complex of fusion protein and gRNA molecule.

In other aspects, the present specification provides complexes comprising the adenine base editors described herein and a gRNA bound to the Cas9 domain of the fusion protein, such as a single guide RNA. The guide RNA may be 15-100 nucleotides in length and comprise a sequence of at least 10, at least 15, or at least 20 contiguous nucleotides that is complementary to a target nucleotide sequence. The guide RNA may comprise a sequence of 15, 16, 17, 18, 19, 20, 21, 22, 23, 24, 25, 26, 27, 28, 29, 30, 31, 32, 33, 34, 35, 36, 37, 38, 39, or 40 contiguous nucleotides that is complementary to a target nucleotide sequence.

In various embodiments, the disclosed ABEs may be complexed, bound, or otherwise associated with (e.g., via any type of covalent or non-covalent bond) one or more guide sequences, i.e., the sequence which becomes associated or bound to the base editor and directs its localization to a specific target sequence having complementarity to the guide sequence or a portion thereof. The particular design embodiments of a guide sequence will depend upon the nucleotide sequence of a genomic target site of interest (i.e., the desired site to be edited) and the type of napDNAbp (e.g., type of Cas protein) present in the base editor, among other factors, such as PAM sequence locations, percent G/C content in the target sequence, the degree of microhomology regions, secondary structures, etc.

In general, a guide sequence is any polynucleotide sequence having sufficient complementarity with a target polynucleotide sequence to hybridize with the target sequence and direct sequence-specific binding of a napDNAbp (e.g., a Cas9, Cas9 homolog, or Cas9 variant) to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies, ELAND (Illumina, San Diego, Calif.), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length.

In some embodiments, a guide sequence is less than about 75, 50, 45, 40, 35, 30, 25, 20, 15, 12, or fewer nucleotides in length. The ability of a guide sequence to direct sequence-specific binding of a base editor to a target sequence may be assessed by any suitable assay. For example, the components of a base editor, including the guide sequence to be tested, may be provided to a host cell having the corresponding target sequence, such as by transfection with vectors encoding the components of a base editor disclosed herein, followed by an assessment of preferential cleavage within the target sequence, such as by Surveyor assay as described herein. Similarly, cleavage of a target polynucleotide sequence may be evaluated in a test tube by providing the target sequence, components of a base editor, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence may be selected to target any target sequence. In some embodiments, the target sequence is a sequence within a genome of a cell. Exemplary target sequences include those that are unique in the target genome. For example, for the *S. pyogenes* Cas9, a unique target sequence in a genome may include a Cas9 target site of the form MMMMMMMMNNNNNNNNNNNNXGG (SEQ ID NO: 196) where NNNNNNNNNNNNXGG (N is A, G, T, or C; and X can be anything) (SEQ ID NO: 197) has a single occurrence in the genome. A unique target sequence in a genome may include an *S. pyogenes* Cas9 target site of the form MMMMMMMMMNNNNNNNNNNNXGG (SEQ ID NO: 198) where NNNNNNNNNNNXGG (N is A, G, T, or C; and X can be anything) (SEQ ID NO: 199) has a single occurrence in the genome. For the *S. thermophilus* CRISPR1Cas9, a unique target sequence in a genome may include a Cas9 target site of the form MMMMMMMMNNNNNNNNNNNNXXAGAAW (SEQ ID NO: 200) where NNNNNNNNNNNNXXAGAAW (N is A, G, T, or C; X can be anything; and W is A or T) (SEQ ID NO: 201) has a single occurrence in the genome. A unique target sequence in a genome may include an *S. thermophilus* CRISPR 1 Cas9 target site of the form MMMMMMMMMNNNNNNNNNNNXXAGAAW (SEQ ID NO: 202) where NNNNNNNNNNNXXAGAAW (N is A, G, T, or C; X can be anything; and W is A or T) (SEQ ID NO: 203) has a single occurrence in the genome. For the *S. pyogenes* Cas9, a unique target sequence in a genome may include a Cas9 target site of the form MMMMMMMMNNNNNNNNNNNNXGGXG (SEQ ID NO: 204) where NNNNNNNNNNNNXGGXG (N is A, G, T, or C; and X can be anything) (SEQ ID NO: 205) has a single occurrence in the genome. A unique target sequence in a genome may include an *S. pyogenes* Cas9 target site of the form MMMMMMMMMNNNNNNNNNNNXGGXG (SEQ ID NO: 206) where NNNNNNNNNNNXGGXG (N is A, G, T, or C; and X can be anything) (SEQ ID NO: 207) has a single occurrence in the genome. In each of these sequences "M" may be A, G, T, or C, and need not be considered in identifying a sequence as unique.

In some embodiments, a guide sequence is selected to reduce the degree of secondary structure within the guide sequence. Secondary structure may be determined by any suitable polynucleotide folding algorithm. Some programs are based on calculating the minimal Gibbs free energy. An example of one such algorithm is mFold, as described by Zuker & Stiegler (*Nucleic Acids Res.* 9 (1981), 133-148). Another example folding algorithm is the online webserver RNAfold, developed at Institute for Theoretical Chemistry at the University of Vienna, using the centroid structure prediction algorithm (see, e.g., A. R. Gruber et al., 2008, *Cell* 106(1): 23-24; and PA Carr & GM Church, 2009, *Nature Biotechnology* 27(12): 1151-62). Additional algorithms may be found in Chuai, G. et al., *DeepCRISPR: optimized CRISPR guide RNA design by deep learning, Genome Biol.* 19:80 (2018), and U.S. application Ser. No. 61/836,080 and U.S. Pat. No. 8,871,445, issued Oct. 28, 2014, the entireties of each of which are incorporated herein by reference.

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a complex at a target sequence, wherein the complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. Preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG. In an embodiment of the disclosure, the transcript or transcribed polynucleotide sequence has at least two or more hairpins. In certain embodiments, the transcript has two, three, four or five hairpins. In a further embodiment of the disclosure, the transcript has at most five hairpins. In some embodiments, the single transcript further includes a transcription termination sequence; preferably this is a polyT sequence, for example six T nucleotides. Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator:

(1) NNNNNNNNgtttttgtactctcaagatttaGAAAtaaatcttgcagaagctacaaagataaggctt catgccgaaatcaacaccctgtcattttatggcagggtgttttcgttatttaaTTTTTT (SEQ ID NO: 208); (2) NNNNNNNNNNNNNNNNNNgtttttgtactctcaGAAAtgcagaagctacaaagataaggcttcatgccgaaatca acaccctgtcattttatggcagggtgttttcgttatttaaTTTTTT (SEQ ID NO: 209); (3) NNNNNNNNNNNNNNNNNNNNgtttttgtactctcaGAAAtgcagaagctacaaagataaggcttcatgccgaa atca acaccctgtcattttatggcagggtgtTTTTT (SEQ ID NO: 210); (4) NNNNNNNNNNNNNNNNNNNNgtttttagagctaGAAAtagcaagttaaaataaggctagtccgttatcaacttga aaa agtggcaccgagtcggtgcTTTTTT (SEQ ID NO: 211); (5) NNNNNNNNNNNNNNNNNNNNgttttagagctaGAAATAGcaagttaaaataaggctagtccgttatcaactt gaa aaagtgTTTTTTT (SEQ ID NO: 212); and (6) NNNNNNNNNNNNNNNNNNNNgttttagagctagAAATAGcaagttaaaataaggctagtccgttatcaTTT TT TTT (SEQ ID NO: 213). In some embodiments, sequences (1) to (3) are used in combination with Cas9 from *S. thermophilus* CRISPRI. In some embodiments, sequences (4) to (6) are used in combination with Cas9 from *S. pyogenes*. In some embodiments, the tracr sequence is a separate transcript from a transcript comprising the tracr mate sequence.

It will be apparent to those of skill in the art that in order to target any of the fusion proteins comprising a Cas9 domain and a methyltransferase, as disclosed herein, to a target site, e.g., a site comprising a point mutation to be edited, it is typically necessary to co-express the fusion protein together with a guide RNA, e.g., an sgRNA. As explained in more detail elsewhere herein, a guide RNA typically comprises a tracrRNA framework allowing for Cas9 binding, and a guide sequence, which confers sequence specificity to the Cas9:base editing enzyme/domain fusion protein.

In some embodiments, the guide RNAs for use in accordance with the disclosed methods of editing comprise a backbone structure that is recognized by an *S. pyogenes* Cas9 protein or domain, such as an SpCas9 domain of the disclosed base editors. The backbone structure recognized by an SpCas9 protein may comprise the sequence 5'-[guide sequence]-guuuuagagcuagaaauagcaaguuaaaauaaggcuagu-ccguuaucaacuugaaaaaguggcaccgagucggugcuuu uu-3' (SEQ ID NO: 214), wherein the guide sequence comprises a sequence that is complementary to the protospacer of the target sequence. See U.S. Publication No. 2015/0166981, published Jun. 18, 2015, the disclosure of which is incorporated by reference herein. The guide sequence is typically 20 nucleotides long.

In other embodiments, the guide RNAs for use in accordance with the disclosed methods of editing comprise a backbone structure that is recognized by an *S. aureus* Cas9 protein. The backbone structure recognized by an SaCas9 protein may comprise the sequence 5'-[guide sequence]-guuuuaguacucuguaaugaaaauuacagaaucuac-uaaaacaaggcaaaaugccguguuuaucucgucaacuuguugg cgagauuuuuuu-3' (SEQ ID NO: 195).

The sequences of suitable guide RNAs for targeting the disclosed fusion proteins to specific genomic target sites will be apparent to those of skill in the art based on the instant disclosure. Such suitable guide RNA sequences typically comprise guide sequences that are complementary to a nucleic sequence within 50 nucleotides upstream or downstream of the target nucleotide to be edited. Some exemplary guide RNA sequences suitable for targeting any of the provided fusion proteins to specific target sequences are provided herein.

Additional guide sequences are are well known in the art and can be used with the base editors described herein. Additional exemplary guide sequences are disclosed in, for example, Jinek M., et al., *Science* 337:816-821(2012); Mali P, Esvelt K M & Church G M (2013) Cas9 as a versatile tool for engineering biology, *Nature Methods,* 10, 957-963; Li J F et al., (2013) Multiplex and homologous recombination-mediated genome editing in *Arabidopsis* and *Nicotiana benthamiana* using guide RNA and Cas9, *Nature Biotechnology,* 31, 688-691; Hwang, W. Y. et al., Efficient genome editing in zebrafish using a CRISPR-Cas system, *Nature Biotechnology* 31, 227-229 (2013); Cong L et al., (2013) Multiplex genome engineering using CRIPSR/Cas systems, *Science,* 339, 819-823; Cho S W et al., (2013) Targeted genome engineering in human cells with the Cas9 RNA-guided endonuclease, *Nature Biotechnology,* 31, 230-232; Jinek, M. et al., RNA-programmed genome editing in human cells, eLife 2, e00471 (2013); Dicarlo, J. E. et al., Genome engineering in *Saccharomyces cerevisiae* using CRISPR-Cas systems. *Nucleic Acid Res*. (2013); Briner A E et al., (2014) Guide RNA functional modules direct Cas9 activity and orthogonality, *Mol Cell,* 56, 333-339, the entire contents of each of which are herein incorporated by reference.

The disclosure further relates in various aspects to methods of making the disclosed improved adenine base editors by various modes of manipulation that include but are not limited to codon optimization to achieve greater expression levels in a cell, and the use of nuclear localization sequences (NLS)s, preferably at least two NLSs, to increase the localization of the expressed base editors into a cell nucleus.

Methods for Making Fusion Proteins

The disclosure further relates in various aspects to methods of making the disclosed fusion proteins by various modes of manipulation that include, but are not limited to, codon optimization to achieve greater expression levels in a cell, and the use of nuclear localization sequences (NLSs), preferably at least two NLSs, e.g., two bipartite NLSs, to increase the localization of the expressed fusion proteins into a cell nucleus.

The fusion proteins contemplated herein can include modifications that result in increased expression, for example, through codon optimization.

In some embodiments, the base editors (or a component thereof) is codon optimized for expression in particular cells, such as eukaryotic cells. The eukaryotic cells may be those of or derived from a particular organism, such as a mammal, including but not limited to human, mouse, rat, rabbit, dog, or non-human primate. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database", and these tables can be adapted in a number of ways. See Nakamura, Y., et al. "Codon usage tabulated from the international DNA sequence databases: status for the year 2000" *Nucl. Acids Res.* 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a CRISPR enzyme correspond to the most frequently used codon for a particular amino acid.

In other embodiments, the base editors of the disclosure have improved expression (as compared to non-modified or state of the art counterpart editors) as a result of ancestral sequence reconstruction analysis. Ancestral sequence reconstruction (ASR) is the process of analyzing modern sequences within an evolutionary/phylogenetic context to infer the ancestral sequences at particular nodes of a tree. These ancient sequences are most often then synthesized, recombinantly expressed in laboratory microorganisms or cell lines, and then characterized to reveal the ancient properties of the extinct biomolecules 2, 3, 4, 5, 6. This process has produced tremendous insights into the mechanisms of molecular adaptation and functional divergence7. Despite such insights, a major criticism of ASR is the general inability to benchmark accuracy of the implemented algorithms. It is difficult to benchmark ASR for many reasons. Notably, genetic material is not preserved in fossils on a long enough time scale to satisfy most ASR studies (many millions to billions of years ago), and it is not yet physically possible to travel back in time to collect samples. Reference is made to Cai et al., "Reconstruction of ancestral protein sequences and its applications," BMC Evolutionary Biology 2004, 4:33 and Zakas et al., "Enhancing the pharmaceutical properties of protein drugs by ancestral sequence reconstruction," *Nature Biotechnology,* 35, pp. 35-37 (2017), each of which are incorporated herein by reference.

There are many software packages available which can perform ancestral state reconstruction. Generally, these software packages have been developed and maintained through the efforts of scientists in related fields and released under free software licenses. The following list is not meant to be a comprehensive itemization of all available packages, but provides a representative sample of the extensive variety of packages that implement methods of ancestral reconstruction with different strengths and features: PAML (Phylogenetic Analysis by Maximum Likelihood, available at /abacus.gene.ucl.ac.uk/software/paml.html), BEAST (Bayesian evolutionary analysis by sampling trees, available at //www.beast2.org/wiki/index.php/Main_Page), and Diversitree (FitzJohn RG, 2012. Diversitree: comparative phylogenetic analyses of diversification in R. Methods in Ecology and Evolution), and HyPHy (Hypothesis testing using phylogenies, available at //hyphy.org/w/index.php/Main_Page).

The Examples demonstrate one embodiment for using ASR to increase overall expression of base editors disclosed herein.

The above description is meant to be non-limiting with regard to making base editors having increased expression, and thereby increase editing efficiencies.

Vectors

Several embodiments of the making and using the base editors of the disclosure relate to vector systems comprising one or more vectors encoding the improved adenine base editors. Vectors may be designed to clone and/or express the adenine base editors of the disclosure. Vectors may also be designed to transfect the adenine base editors of the disclosure into one or more cells, e.g., a target diseased eukaryotic cell for treatment with the base editor systems and methods disclosed herein.

Vectors may be designed for expression of base editor transcripts (e.g. nucleic acid transcripts, proteins, or enzymes) in prokaryotic or eukaryotic cells. For example, base editor transcripts may be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press. San Diego, Calif. (1990). Alternatively, expression vectors encoding one or more adenine base editors described herein may be transcribed and translated in vitro, for example using T7 promoter regulatory sequences and T7 polymerase.

Vectors may be introduced and propagated in a prokaryotic cells. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins.

Fusion expression vectors also may be used to express the adenine base editors of the disclosure. Such vectors generally add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) *Gene* 69:301-315) and pET 11d (Studier et al., GENE EXPRESSION TECHNOLOGY: METHODS IN ENZYMOLOGY 185, *Academic Press*, San Diego, Calif. (1990) 60-89).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. *Mol. Cell. Biol.* 3: 2156-2165) and the pVL series (Lucklow and Summers, 1989. *Virology* 170: 31-39).

In some embodiments, a vector is capable of driving expression of one or more sequences in mammalian cells using a mammalian expression vector. Examples of mammalian expression vectors include pCDM8 (Seed, 1987. *Nature* 329: 840) and pMT2PC (Kaufman, et al., 1987. *EMBO J.* 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. *Genes Dev.* 1: 268-277), lymphoid-specific promoters (Calame and Eaton, 1988. *Adv. Immunol.* 43: 235-275), in particular promoters of T cell receptors (Winoto and Baltimore, 1989. *EMBO J.* 8: 729-733) and immunoglobulins (Baneiji, et al., 1983. *Cell* 33: 729-740; Queen and Baltimore, 1983. *Cell* 33: 741-748), neuron-specific promoters (e.g., the neurofilament promoter; Byrne and Ruddle, 1989. *Proc. Natl. Acad. Sci. USA* 86: 5473-5477), pancreas-specific promoters (Edlund, et al., 1985. *Science* 230: 912-916), and mammary gland-specific promoters (e.g., milk whey promoter, U.S. Pat. No. 4,873,316 and European Application Publication No. 264,166). Developmentally-regulated promoters are also encompassed, e.g., the murine hox promoters (Kessel and Gruss, 1990. *Science* 249: 374-379) and the α-fetoprotein promoter (Campes and Tilghman, 1989. *Genes Dev.* 3: 537-546).

Methods of Editing a Target Nucleobase Pair, Methods of Treatment, and Uses for the ABEs Some embodiments of the disclosure provide methods for editing a nucleic acid (e.g., a base pair of a double-stranded DNA sequence). In some embodiments, the method comprises the steps of: a) contacting a target region of a nucleic acid (e.g., a double-stranded DNA sequence) with a complex comprising a base editor (e.g., a Cas9 domain fused to an adenosine deaminase domain) and a guide nucleic acid (e.g., gRNA), wherein the target region comprises a targeted nucleobase pair. As a result of embodiments of these methods, strand separation of said target region is induced, a first nucleobase of said target nucleobase pair in a single strand of the target region is converted to a second nucleobase, and no more than one strand of said target region is cut (or nicked), wherein a third nucleobase complementary to the first nucleobase base is replaced by a fourth nucleobase complementary to the second nucleobase.

In other aspects, the present disclosure provides for methods of making the adenine base editors described herein, as well as methods of using the adenine base editors or nucleic acid molecules encoding the adenine base editors in applications including editing a nucleic acid molecule, e.g., a genome. In certain embodiments, methods of engineering the adenine base editors to have reduced RNA editing effects while retaining excellent DNA editing efficiency involve mutagenesis. In certain embodiments, following the successful mutagenesis of the one or more components of the adenine base editor (e.g., one or more adenosine deaminases), methods of making the base editors comprise recombinant protein expression methodologies known to one of ordinary skill in the art.

In some embodiments, the first nucleobase is an adenine. In some embodiments, the second nucleobase is a deaminated adenine, or hypoxanthine. In some embodiments, the third nucleobase is a thymine (of the target A:T base pair). In some embodiments, the fourth nucleobase is a cytosine. In some embodiments, the method further comprises replacing the second nucleobase with a fifth nucleobase (guanine) that is complementary to the fourth nucleobase, thereby generating an intended edited base pair (e.g., A:T to G:C). In some embodiments, at least 5% of the intended base pairs are edited.

In some embodiments, at least 10%, 15%, 20%, 25%, 30%, 35%, 40%, 45%, or 50% of the intended base paires are edited. In various embodiments, the disclosed editing methods result in a DNA base editing efficiency of at least about 35%, 40%, 50%, 60%, 70%, 80%, 85%, 90%, 95%, 98%, or 99%. The step of contacting may result in in a DNA base editing efficiency of at least about 51%, 52%, 53%, 54%, 55%, 56% or 57%. In particular, the step of contacting results in base editing efficiencies of greater than 54%. In certain embodiments, base editing efficiencies of 99% may be realized.

In some embodiments, the disclosed editing methods result in an actual or average off-target DNA editing frequency of about 2.0% or less, 1.75% or less, 1.5% or less, 1.2% or less, 1% or less, 0.9% or less, 0.8% or less, 0.75% or less, 0.7% or less, 0.65% or less, or 0.6% or less. In a particular embodiment, the methods result in an actual or average off-target DNA editing frequence of 0.79±0.18%.

In some embodiments, the ratio of intended products to unintended products in the target nucleotide is at least 2:1, 5:1, 10:1, 20:1, 30:1, 40:1, 50:1, 60:1, 70:1, 80:1, 90:1, 100:1, or 200:1, or more. In some embodiments, the intended edited base pair is upstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides upstream of the PAM site. In some embodiments, the intended edited basepair is downstream of a PAM site. In some embodiments, the intended edited base pair is 1, 2, 3, 4, 5, 6, 7, 8, 9, 10, 11, 12, 13, 14, 15, 16, 17, 18, 19, or 20 nucleotides downstream stream of the PAM site. In some embodiments, the method does not require a canonical (e.g., NGG) PAM site. In some embodiments, the target region comprises a target window, wherein the target window comprises the target nucleobase pair. In some embodiments, the target window comprises 1-10 nucleotides. In some embodiments, the target window is 1-9, 1-8, 1-7, 1-6, 1-5, 1-4, 1-3, 1-2, or 1 nucleotides in length. In some embodiments, the target window is 1, 2, 3, 4, 5, 6, 7, 8, 9, 10, 11, 12, 13, 14, 15, 16, 17, 18, 19, or 20 nucleotides in length. In some embodiments, the intended edited base pair is within the target window. In some embodiments, the target window comprises the intended edited base pair. In some embodiments, the method is performed using any of the adenine base editors provided herein. In some embodiments, a target window is a deamination window.

In some embodiments, the disclosure provides a method for editing a nucleobase pair of a double-stranded DNA sequence. In some embodiments, the method comprises a) contacting a target region of the double-stranded DNA sequence with a complex comprising a base editor and a guide nucleic acid (e.g., gRNA), where the target region comprises a target nucleobase pair (e.g., A:T target base pair), b) converting a first nucleobase (e.g., the A base) of said target nucleobase pair in a single strand of the target region to a second nucleobase (e.g., hypoxanthine), c) cutting (or nicking) no more than one strand of said target region, wherein a third nucleobase complementary to the first nucleobase base is replaced by a fourth nucleobase (cytosine) that is complementary to the second nucleobase, and the second nucleobase is replaced with a fifth nucleobase that is complementary to the fourth nucleobase, thereby generating an intended edited base pair, wherein the efficiency of generating the intended edited base pair is at least 5%.

In some embodiments, the cut single strand is hybridized to the guide nucleic acid. In some embodiments, the cut single strand is opposite to the strand comprising the first nucleobase. In some embodiments, the first base is adenine. In some embodiments, the second nucleobase is not G, C, A, or T. In some embodiments, the second base is hypoxanthine. In some embodiments, the base editor inhibits base excision repair of the edited strand. In some embodiments, the base editor protects (e.g., from base excision repair) or binds the non-edited strand. In some embodiments, the base editor comprises UGI activity. In some embodiments, the base editor comprises a catalytically inactive inosine-specific nuclease. In some embodiments, the base editor comprises nickase activity.

In another embodiment, the disclosure provides editing methods comprising contacting a DNA, or RNA molecule with any of the adenine base editors provided herein, and with at least one guide nucleic acid (e.g., guide RNA), wherein the guide nucleic acid, (e.g., guide RNA) is about 15-100 nucleotides long and comprises a sequence of at least 10 contiguous nucleotides that is complementary to a target sequence. In some embodiments, the 3' end of the target sequence is immediately adjacent to a canonical PAM sequence (NGG). In some embodiments, the 3' end of the target sequence is not immediately adjacent to a canonical PAM sequence (NGG). In some embodiments, the 3' end of the target sequence is immediately adjacent to an AGC, GAG, TTT, GTG, or CAA sequence.

In some embodiments, the target DNA sequence comprises a sequence associated with a disease or disorder. In some embodiments, the target DNA sequence comprises a point mutation associated with a disease or disorder. In some embodiments, the activity of the fusion protein (e.g., comprising an adenosine deaminase and a Cas9 domain), or the complex, results in a correction of the point mutation. In some embodiments, the target DNA sequence comprises a G to A point mutation associated with a disease or disorder, and wherein the deamination of the mutant A base results in a sequence that is not associated with a disease or disorder. In some embodiments, the target DNA sequence encodes a protein, and the point mutation is in a codon and results in a change in the amino acid encoded by the mutant codon as compared to the wild-type codon. In some embodiments, the deamination of the mutant A results in a change of the amino acid encoded by the mutant codon. In some embodiments, the deamination of the mutant A results in the codon encoding the wild-type amino acid. In some embodiments, the contacting is in vivo in a subject. In some embodiments, the subject has or has been diagnosed with a disease or disorder. In some embodiments, the disease or disorder is phenylketonuria, von Willebrand disease (vWD), a neoplastic disease associated with a mutant PTEN or BRCA1, or Li-Fraumeni syndrome. A list of exemplary diseases and disorders that may be treated using the base editors described herein is shown in Table 7. Table 7 includes the target gene, the mutation to be corrected, the related disease and the nucleotide sequence of the associated protospacer and PAM.

TABLE 7

List of exemplary diseases that may be treated using the base editors described herein. The Adenine to be edited in the protospacer is indicated by underlining and the PAM is indicated in bold.

| Target Gene | Mutation | ATCC Cell Line | Disease | Protospacer and PAM |
|---|---|---|---|---|
| PTEN | Cys136Tyr | HTB-128 | Cancer Predis-position | tatatgcatatttattacatcgg (SEQ ID NO: 246) |

TABLE 7-continued

List of exemplary diseases that may be treated using the base editors described herein. The Adenine to be edited in the protospacer is indicated by underlining and the PAM is indicated in bold.

| Target Gene | Mutation | ATCC Cell Line | Disease | Protospacer and PAM |
|---|---|---|---|---|
| PTEN | Arg233Ter | HTB-13 | Cancer Predis-position | tcgtcatgtg ggtcctgaat tgg (SEQ ID NO: 247) |
| TP53 | Glu258Lys | HTB-65 | Cancer Predis-position | acactgaaag actccaggtc agg (SEQ ID NO: 248) |
| BRCA1 | Gly1738Arg | NA | Cancer Predis-position | gtcagaagag atgtggtcaa tgg (SEQ ID NO: 249) |
| BRCA1 | 4097-1G > A | NA | Cancer Predis-position | tttaaagtga agcagcatct ggg (SEQ ID NO: 250) |
| BRCA1 | 4097-1G > A | NA | Cancer Predis-position | atttaaagtg aagcagcatc tgg (SEQ ID NO: 251) |
| PAH | Thr380Mct | NA | Phenyl-ketonuria | actccatgac agtgtaattt tgg (SEQ ID NO: 252) |
| VWF | Scr1285Phe | NA | von Willebrand (Hemo-philia) | gcctggagaa gccatccagc agg (SEQ ID NO: 253) |
| VWF | Arg2535Tcr | NA | von Willebrand (Hemo-philia) | ctcagacaca ctcattgatg agg (SEQ ID NO: 254) |
| TP53 | Arg175His | HCC1395 | Li-Fraumeni syndrome | gaggcactgc ccccaccatg agcg (SEQ ID NO: 255) |

Some embodiments provide methods for targeted editing using the adenine base editors provided herein. In some embodiments, the base editors are used to introduce a point mutation into a nucleic acid by deaminating a target nucleobase, e.g., an A residue. In some embodiments, the deamination of the target nucleobase results in the correction of a genetic defect, e.g., in the correction of a point mutation that leads to a loss of function in a gene product. In some embodiments, the genetic defect is associated with a disease or disorder, e.g., a lysosomal storage disorder or a metabolic disease, such as, for example, type I diabetes. In some embodiments, the methods provided herein are used to introduce a deactivating point mutation into a gene or allele that encodes a gene product that is associated with a disease or disorder. For example, in some embodiments, methods are provided herein that employ a DNA editing fusion protein to introduce a deactivating point mutation into an oncogene (e.g., in the treatment of a proliferative disease). A deactivating mutation may, in some embodiments, generate a premature stop codon in a coding sequence, which results in the expression of a truncated gene product, e.g., a truncated protein lacking the function of the full-length protein.

In some embodiments, the purpose of the methods provided herein is to restore the function of a dysfunctional gene via genome editing. The nucleobase editing proteins provided herein can be validated for gene editing-based human therapeutics in vitro, e.g., by correcting a disease-associated mutation in human cell culture. It will be understood by the skilled artisan that the nucleobase editing proteins provided herein, e.g., the fusion proteins comprising a nucleic acid programmable DNA binding protein (e.g., Cas9) and an adenosine deaminase domain may be used to correct any single point G to A or C to T mutation. In the first case, deamination of the mutant A to I corrects the mutation, and in the latter case, deamination of the A that is base-paired with the mutant T, followed by a round of replication, corrects the mutation. Exemplary point mutations that may be corrected are listed in Tables 1.

The successful correction of point mutations in disease-associated genes and alleles opens up new strategies for gene correction with applications in therapeutics and basic research. Site-specific single-base modification systems like the disclosed fusions of a nucleic acid programmable DNA binding protein and an adenosine deaminase domain also have applications in "reverse" gene therapy, where certain gene functions are purposely suppressed or abolished. In these cases, site-specifically mutating residues that lead to inactivating mutations in a protein, or mutations that inhibit function of the protein may be used to abolish or inhibit protein function Methods of Treatment The instant disclosure provides methods for the treatment of a subject diagnosed with a disease associated with or caused by a point mutation that may be corrected by a DNA editing fusion protein provided herein. For example, in some embodiments, a method is provided that comprises administering to a subject having such a disease, e.g., a cancer associated with a point mutation as described above, an effective amount of an adenosine deaminase fusion protein that corrects the point mutation or introduces a deactivating mutation into a disease-associated gene. In some embodiments, the disease is a proliferative disease. In some embodiments, the disease is a genetic disease. In some embodiments, the disease is a neoplastic disease. In some embodiments, the disease is a metabolic disease. In some embodiments, the disease is a lysosomal storage disease. Other diseases that may be treated by correcting a point mutation or introducing a deactivating mutation into a disease-associated gene will be known to those of skill in the art, and the disclosure is not limited in this respect.

The instant disclosure provides methods for the treatment of additional diseases or disorders, e.g., diseases or disorders that are associated or caused by a point mutation that may be corrected by deaminase-mediated gene editing. Some such diseases are described herein, and additional suitable diseases that may be treated with the strategies and fusion proteins provided herein will be apparent to those of skill in the art based on the instant disclosure. Exemplary suitable diseases and disorders are listed below. It will be understood that the numbering of the specific positions or residues in the respective sequences depends on the particular protein and numbering scheme used. Numbering might be different, e.g., in precursors of a mature protein and the mature protein itself, and differences in sequences from species to species may affect numbering. One of skill in the art will be able to identify the respective residue in any homologous protein and in the respective encoding nucleic acid by methods well known in the art, e.g., by sequence alignment and determination of homologous residues. Exemplary suitable diseases and disorders include, without limitation: 2-methyl-3-hydroxybutyric aciduria; 3 beta-Hydroxysteroid dehydrogenase deficiency; 3-Methylglutaconic aciduria; 3-Oxo-5 alpha-steroid delta 4-dehydrogenase deficiency; 46,XY sex reversal, type 1, 3, and 5; 5-Oxoprolinase deficiency; 6-pyruvoyl-tetrahydropterin synthase deficiency; Aarskog syndrome; Aase syndrome; Achondrogenesis type 2; Achromatopsia 2 and 7; Acquired long QT syndrome; Acrocallosal syndrome, Schinzel type; Acrocapitofemoral dysplasia; Acrodysostosis 2, with or without hormone resistance; Acroerythrokeratoderma; Acromicric dysplasia; Acth-independent macronodular adrenal hyperplasia 2; Activated PI3K-delta syndrome; Acute intermittent *porphyria*; deficiency of Acyl-CoA dehydrogenase family, member 9; Adams-Oliver syndrome 5 and 6; Adenine phosphoribosyltransferase deficiency; Adenylate kinase deficiency; hemolytic anemia due to Adenylosuccinate lyase deficiency; Adolescent nephronophthisis; Renal-hepatic-pancreatic dysplasia; Meckel syndrome type 7; Adrenoleukodystrophy; Adult junctional epidermolysis bullosa; Epidermolysis bullosa, junctional, localisata variant; Adult neuronal ceroid lipofuscinosis; Adult neuronal ceroid lipofuscinosis; Adult onset ataxia with oculomotor apraxia; ADULT syndrome; Afibrinogenemia and congenital Afibrinogenemia; autosomal recessive Agammaglobulinemia 2; Age-related macular degeneration 3, 6, 11, and 12; Aicardi Goutieres syndromes 1, 4, and 5; Chilbain lupus 1; Alagille syndromes 1 and 2; Alexander disease; Alkaptonuria; Allan-Herndon-Dudley syndrome; Alopecia universalis congenital; Alpers encephalopathy; Alpha-i-antitrypsin deficiency; autosomal dominant, autosomal recessive, and X-linked recessive Alport syndromes; Alzheimer disease, familial, 3, with spastic paraparesis and apraxia; Alzheimer disease, types, 1, 3, and 4; hypocalcification type and hypomaturation type, IIA1 Amelogenesis imperfecta; Aminoacylase 1 deficiency; Amish infantile epilepsy syndrome; Amyloidogenic transthyretin amyloidosis; Amyloid Cardiomyopathy, Transthyretin-related; Cardiomyopathy; Amyotrophic lateral sclerosis types 1, 6, 15 (with or without frontotemporal dementia), 22 (with or without frontotemporal dementia), and 10; Frontotemporal dementia with TDP43 inclusions, TARDBP-related; Andermann syndrome; Andersen Tawil syndrome; Congenital long QT syndrome; Anemia, nonspherocytic hemolytic, due to G6PD deficiency; Angelman syndrome; Severe neonatal-onset encephalopathy with microcephaly; susceptibility to Autism, X-linked 3; Angiopathy, hereditary, with nephropathy, aneurysms, and muscle cramps; Angiotensin i-converting enzyme, benign serum increase; Aniridia, cerebellar ataxia, and mental retardation; Anonychia; Antithrombin III deficiency; Antley-Bixler syndrome with genital anomalies and disordered steroidogenesis; Aortic aneurysm, familial thoracic 4, 6, and 9; Thoracic aortic aneurysms and aortic dissections; Multisystemic smooth muscle dysfunction syndrome; Moyamoya disease 5; Aplastic anemia; Apparent mineralocorticoid excess; Arginase deficiency; Argininosuccinate lyase deficiency; Aromatase deficiency; Arrhythmogenic right ventricular cardiomyopathy types 5, 8, and 10; Primary familial hypertrophic cardiomyopathy; Arthrogryposis multiplex congenita, distal, X-linked; Arthrogryposis renal dysfunction cholestasis syndrome; Arthrogryposis, renal dysfunction, and cholestasis 2; Asparagine synthetase deficiency; Abnormality of neuronal migration; Ataxia with vitamin E deficiency; Ataxia, sensory, autosomal dominant; Ataxia-telangiectasia syndrome; Hereditary cancer-predisposing syndrome; Atransferrinemia; Atrial fibrillation, familial, 11, 12, 13, and 16; Atrial septal defects 2, 4, and 7 (with or without atrioventricular conduction defects); Atrial standstill 2; Atrioventricular septal defect 4; Atrophia bulborum hereditaria; ATR-X syndrome; Auriculocondylar syndrome 2; Autoimmune disease, multisystem, infantile-onset; Autoimmune lymphoproliferative syndrome, type 1a; Autosomal dominant hypohidrotic ectodermal dysplasia; Autosomal dominant progressive external ophthalmoplegia with mitochondrial DNA deletions 1 and 3; Autosomal dominant torsion dystonia 4; Autosomal recessive centronuclear myopathy; Autosomal recessive congenital ichthyosis 1, 2, 3, 4A, and 4B; Autosomal recessive cutis laxa type IA and 1B; Autosomal recessive hypohidrotic ectodermal dysplasia syndrome; Ectodermal dysplasia 1Ib; hypohidrotic/hair/tooth type, autosomal recessive; Autosomal recessive hypophosphatemic bone disease; Axenfeld-Rieger syndrome type 3; Bainbridge-Ropers syndrome; Bannayan-Riley-Ruvalcaba syndrome; PTEN hamartoma tumor syndrome; Baraitser-Winter syndromes 1 and 2; Barakat syndrome; Bardet-Biedl syndromes 1, 11, 16, and 19; Bare lymphocyte syndrome type 2, complementation group E; Bartter syndrome antenatal type 2; Bartter syndrome types 3, 3 with hypocalciuria, and 4; Basal ganglia calcification, idiopathic, 4; Beaded hair; Benign familial hematuria; Benign familial neonatal seizures 1 and 2; Seizures, benign familial neonatal, 1, and/or myokymia; Seizures, Early infantile epileptic encephalopathy 7; Benign familial neonatal-infantile seizures; Benign hereditary chorea; Benign scapuloperoneal muscular dystrophy with cardiomyopathy; Bernard-Soulier syndrome, types A1 and A2 (autosomal dominant); Bestrophinopathy, autosomal recessive; beta Thalassemia; Bethlem myopathy and Bethlem myopathy 2; Bietti crystalline corneoretinal dystrophy; Bile acid synthesis defect, congenital, 2; Biotinidase deficiency; Birk Barel mental retardation dysmorphism syndrome; Blepharophimosis, ptosis, and epicanthus inversus; Bloom syndrome; Borjeson-Forssman-Lehmann syndrome; Boucher Neuhauser syndrome; Brachydactyly types A1 and A2; Brachydactyly with hypertension; Brain small vessel disease with hemorrhage; Branched-chain ketoacid dehydrogenase kinase deficiency; Branchiootic syndromes 2 and 3; Breast cancer, early-onset; Breast-ovarian cancer, familial 1, 2, and 4; Brittle cornea syndrome 2; Brody myopathy; Bronchiectasis with or without elevated sweat chloride 3; Brown-Vialetto-Van laere syndrome and Brown-Vialetto-Van Laere syndrome 2; Brugada syndrome; Brugada syndrome 1; Ventricular fibrillation; Paroxysmal familial ventricular fibrillation; Brugada syndrome and Brugada syndrome 4; Long QT syndrome; Sudden cardiac death; Bull eye macular dystrophy; Stargardt disease 4; Cone-rod dystrophy 12; Bullous ichthyosiform erythroderma; Burn-Mckeown syndrome; Candidiasis, familial, 2, 5, 6, and 8; Carbohydrate-deficient glycoprotein syndrome type I and II; Carbonic anhydrase VA deficiency, hyperammonemia due to; Carcinoma of colon; Cardiac arrhythmia; Long QT syndrome, LQT1 subtype; Cardioencephalomyopathy, fatal infantile, due to cytochrome c oxidase deficiency; Cardiofaciocutaneous syndrome; Cardiomyopathy; Danon disease; Hypertrophic cardiomyopathy; Left ventricular noncompaction cardiomyopathy; Carnevale syndrome; Carney complex, type 1; Carnitine acylcarnitine translocase deficiency; Carnitine palmitoyltransferase I, II, II (late onset), and II (infantile) deficiency; Cataract 1, 4, autosomal dominant, autosomal dominant, multiple types, with microcornea, coppock-like, juvenile, with microcornea and glucosuria, and nuclear diffuse nonprogressive; Catecholaminergic polymorphic ventricular tachycardia; Caudal regression syndrome; Cd8 deficiency, familial; Central core disease; Centromeric instability of chromosomes 1,9 and 16 and immunodeficiency; Cerebellar ataxia infantile with progressive external ophthalmoplegi and Cerebellar ataxia, mental retardation, and dysequilibrium syndrome 2; Cerebral amyloid angiopathy, APP-related; Cerebral autosomal dominant and recessive arteriopathy with subcortical infarcts and leukoencephalopathy; Cerebral cavernous malformations 2; Cerebrooculofacioskeletal syndrome 2; Cerebro-oculo-facio-skeletal syndrome; Cerebroretinal microangiopathy with calcifications and cysts; Ceroid lipofuscinosis neuronal 2, 6, 7, and 10; Ch\xc3\xa9diak-Higashi syndrome, Chediak-Higashi syndrome, adult type; Charcot-Marie-Tooth disease types 1B, 2B2, 2C, 2F, 2I, 2U (axonal), 1C (demyelinating), dominant intermediate C, recessive intermediate A, 2A2, 4C, 4D, 4H, IF, IVF, and X; Scapuloperoneal spinal muscular atrophy; Distal spinal muscular atrophy, congenital nonprogressive; Spinal muscular atrophy, distal, autosomal recessive, 5; CHARGE association; Childhood hypophosphatasia; Adult hypophosphatasia; Cholecystitis; Progressive familial intrahepatic cholestasis 3; Cholestasis, intrahepatic, of pregnancy 3; Cholestanol storage disease; Cholesterol monooxygenase (side-chain cleaving) deficiency; Chondrodysplasia Blomstrand type; Chondrodysplasia *punctata* 1, X-linked recessive and 2 X-linked dominant; CHOPS syndrome; Chronic granulomatous disease, autosomal recessive cytochrome b-positive, types 1 and 2; Chudley-McCullough syndrome; Ciliary dyskinesia, primary, 7, 11, 15, 20 and 22; Citrullinemia type I; Citrullinemia type I and II; Cleidocranial dysostosis; C-like syndrome; Cockayne syndrome type A,; Coenzyme Q10 deficiency, primary 1, 4, and 7; Coffin Siris/Intellectual Disability; Coffin-Lowry syndrome; Cohen syndrome,; Cold-induced sweating syndrome 1; COLE-CARPENTER SYNDROME 2; Combined cellular and humoral immune defects with granulomas; Combined d-2- and l-2-hydroxyglutaric aciduria; Combined malonic and methylmalonic aciduria; Combined oxidative phosphorylation deficiencies 1, 3, 4, 12, 15, and 25; Combined partial and complete 17-alpha-hydroxylase/17,20-lyase deficiency; Common variable immunodeficiency 9; Complement component 4, partial deficiency of, due to dysfunctional cI inhibitor; Complement factor B deficiency; Cone monochromatism; Cone-rod dystrophy 2 and 6; Cone-rod dystrophy amelogenesis imperfecta; Congenital adrenal hyperplasia and Congenital adrenal hypoplasia, X-linked; Congenital amegakaryocytic thrombocytopenia; Congenital aniridia; Congenital central hypoventilation; Hirschsprung disease 3; Congenital contractural arachnodactyly; Congenital contractures of the limbs and face, hypotonia, and developmental delay; Congenital disorder of glycosylation types 1B, 1D, 1G, 1H, 1J, 1K, 1N, 1P, 2C, 2J, 2K, IIm; Congenital dyserythropoietic anemia, type I and II; Congenital ectodermal dysplasia of face; Congenital erythropoietic porphyria; Congenital generalized lipodystrophy type 2; Congenital heart disease, multiple types, 2; Congenital heart disease; Interrupted aortic arch; Congenital lipomatous overgrowth, vascular malformations, and epidermal nevi; Non-small cell lung cancer; Neoplasm of ovary; Cardiac conduction defect, nonspecific; Congenital microvillous atrophy; Congenital muscular dystrophy; Congenital muscular dystrophy due to partial LAMA2 deficiency; Congenital muscular dystrophy-dystroglycanopathy with brain and eye anomalies, types A2, A7, A8, A11, and A14; Congenital muscular dystrophy-dystroglycanopathy with mental retardation, types B2, B3, B5, and B15; Congenital muscular dystrophy-dystroglycanopathy without mental retardation, type B5; Congenital muscular hypertrophy-cerebral syndrome; Congenital myasthenic syndrome, acetazolamide-responsive; Congenital myopathy with fiber type disproportion; Congenital ocular coloboma; Congenital stationary night blindness, type 1A, 1B, 1C, 1E, 1F, and 2A; Coproporphyria; Cornea plana 2; Corneal dystrophy, Fuchs endothelial, 4; Corneal endothelial dystrophy type 2; Corneal fragility keratoglobus, blue sclerae and joint hypermobility; Cornelia de Lange syndromes 1 and 5; Coronary artery disease, autosomal dominant 2; Coronary heart disease; Hyperalphalipoproteinemia 2; Cortical dysplasia, complex, with other brain malformations 5 and 6; Cortical malformations, occipital; Corticosteroid-binding globulin deficiency; Corticosterone methyloxidase type 2 deficiency; Costello syndrome; Cowden syndrome 1; Coxa plana; Craniodiaphyseal dysplasia, autosomal dominant; Craniosynostosis 1 and 4; Craniosynostosis and dental anomalies; Creatine deficiency, X-linked; Crouzon syndrome; Cryptophthalmos syndrome; Cryptorchidism, unilateral or bilateral; Cushing symphalangism; Cutaneous malignant melanoma 1; Cutis laxa with osteodystrophy and with severe pulmonary, gastrointestinal, and urinary abnormalities; Cyanosis, transient neonatal and atypical nephropathic; Cystic fibrosis; Cystinuria; Cytochrome c oxidase i deficiency; Cytochrome-c oxidase deficiency; D-2-hydroxyglutaric aciduria 2; Darier disease, segmental; Deafness with labyrinthine aplasia microtia and microdontia (LAMM); Deafness, autosomal dominant 3a, 4, 12, 13, 15, autosomal dominant nonsyndromic sensorineural 17, 20, and 65; Deafness, autosomal recessive 1A, 2, 3, 6, 8, 9, 12, 15, 16, 18b, 22, 28, 31, 44, 49, 63, 77, 86, and 89; Deafness, cochlear, with myopia and intellectual impairment, without vestibular involvement, autosomal dominant, X-linked 2; Deficiency of 2-methylbutyryl-CoA dehydrogenase; Deficiency of 3-hydroxyacyl-CoA dehydrogenase; Deficiency of alpha-mannosidase; Deficiency of aromatic-L-amino-acid decarboxylase; Deficiency of bisphosphoglycerate mutase; Deficiency of butyryl-CoA dehydrogenase; Deficiency of ferroxidase; Deficiency of galactokinase; Deficiency of guanidinoacetate methyltransferase; Deficiency of hyaluronoglucosaminidase; Deficiency of ribose-5-phosphate isomerase; Deficiency of steroid 11-beta-monooxygenase; Deficiency of UDPglucose-hexose-1-phosphate uridylyltransferase; Deficiency of xanthine oxidase; Dejerine-Sottas disease; Charcot-Marie-Tooth disease, types ID and IVF; Dejerine-Sottas syndrome, autosomal dominant; Dendritic cell, monocyte, B lymphocyte, and natural killer lymphocyte deficiency; Desbuquois dysplasia 2; Desbuquois syndrome; DFNA 2 Nonsyndromic Hearing Loss; Diabetes mellitus and insipidus with optic atrophy and deafness; Diabetes mellitus, type 2, and insulin-dependent, 20; Diamond-Blackfan anemia 1, 5, 8, and 10; Diarrhea 3 (secretory sodium, congenital, syndromic) and 5 (with tufting enteropathy, congenital); Dicarboxylic aminoaciduria; Diffuse palmoplantar keratoderma, Bothnian type; Digitorenocerebral syndrome; Dihydropteridine reductase deficiency; Dilated cardiomyopathy 1A, 1AA, 1C, 1G, 1BB, 1DD, 1FF, 1HH, 11, 1KK, 1N, 1S, 1Y, and 3B; Left ventricular noncompaction 3; Disordered steroidogenesis due to cytochrome p450 oxidoreductase deficiency; Distal arthrogryposis type 2B; Distal hereditary motor neuronopathy type 2B; Distal myopathy Markesbery-Griggs type; Distal spinal muscular atrophy, X-linked 3; Distichiasis-lymphedema syndrome; Dominant dystrophic epidermolysis bullosa with absence of skin; Dominant hereditary optic atrophy; Donnai Barrow syndrome; Dopamine beta hydroxylase deficiency; Dopamine receptor d2, reduced brain density of; Dowling-degos disease 4; Doyne honeycomb retinal dystrophy; Malattia leventinese; Duane syndrome type 2; Dubin-Johnson syndrome; Duchenne muscular dystrophy; Becker muscular dystrophy; Dysfibrinogenemia; Dyskeratosis congenita autosomal dominant and autosomal dominant, 3; Dyskeratosis congenita, autosomal recessive, 1, 3, 4, and 5; Dyskeratosis congenita X-linked; Dyskinesia, familial, with facial myokymia; Dysplasminogenemia; Dystonia 2 (torsion, autosomal recessive), 3 (torsion, X-linked), 5 (Dopa-responsive type), 10, 12, 16, 25, 26 (Myoclonic); Seizures, benign familial infantile, 2; Early infantile epileptic encephalopathy 2, 4, 7, 9, 10, 11, 13, and 14; Atypical Rett syndrome; Early T cell progenitor acute lymphoblastic leukemia; Ectodermal dysplasia skin fragility syndrome; Ectodermal dysplasia-syndactyly syndrome 1; Ectopia lentis, isolated autosomal recessive and dominant; Ectrodactyly, ectodermal dysplasia, and cleft lip/palate syndrome 3; Ehlers-Danlos syndrome type 7 (autosomal recessive), classic type, type 2 (progeroid), hydroxylysine-deficient, type 4, type 4 variant, and due to tenascin-X deficiency; Eichsfeld type congenital muscular dystrophy; Endocrine-cerebroosteodysplasia; Enhanced s-cone syndrome; Enlarged vestibular aqueduct syndrome; Enterokinase deficiency; Epidermodysplasia verruciformis; Epidermolysa bullosa simplex and limb girdle muscular dystrophy, simplex with mottled pigmentation, simplex with pyloric atresia, simplex, autosomal recessive, and with pyloric atresia; Epidermolytic palmoplantar keratoderma; Familial febrile seizures 8; Epilepsy, childhood absence 2, 12 (idiopathic generalized, susceptibility to) 5 (nocturnal frontal lobe), nocturnal frontal lobe type 1, partial, with variable foci, progressive myoclonic 3, and X-linked, with variable learning disabilities and behavior disorders; Epileptic encephalopathy, childhood-onset, early infantile, 1, 19, 23, 25, 30, and 32; Epiphyseal dysplasia, multiple, with myopia and conductive deafness; Episodic ataxia type 2; Episodic pain syndrome, familial, 3; Epstein syndrome; Fechtner syndrome; Erythropoietic protoporphyria; Estrogen resistance; Exudative vitreoretinopathy 6; Fabry disease and Fabry disease, cardiac variant; Factor H, VII, X, v and factor viii, combined deficiency of 2, xiii, a subunit, deficiency; Familial adenomatous polyposis 1 and 3; Familial amyloid nephropathy with urticaria and deafness; Familial cold urticarial; Familial aplasia of the vermis; Familial benign pemphigus; Familial cancer of breast; Breast cancer, susceptibility to; Osteosarcoma; Pancreatic cancer 3; Familial cardiomyopathy; Familial cold autoinflammatory syndrome 2; Familial colorectal cancer; Familial exudative vitreoretinopathy, X-linked; Familial hemiplegic migraine types 1 and 2; Familial hypercholesterolemia; Familial hypertrophic cardiomyopathy 1, 2, 3, 4, 7, 10, 23 and 24; Familial hypokalemia-hypomagnesemia; Familial hypoplastic, glomerulocystic kidney; Familial infantile myasthenia; Familial juvenile gout; Familial Mediterranean fever and Familial mediterranean fever, autosomal dominant; Familial porencephaly; Familial *porphyria* cutanea *tarda*; Familial pulmonary capillary hemangiomatosis; Familial renal glucosuria; Familial renal hypouricemia; Familial restrictive cardiomyopathy 1; Familial type 1 and 3 hyperlipoproteinemia; Fanconi anemia, complementation group E, I, N, and O; Fanconi-Bickel syndrome; Favism, susceptibility to; Febrile seizures, familial, 11; Feingold syndrome 1; Fetal hemoglobin quantitative trait locus 1; FG syndrome and FG syndrome 4; Fibrosis of extraocular muscles, congenital, 1, 2, 3a (with or without extraocular involvement), 3b; Fish-eye disease; Fleck corneal dystrophy; Floating-Harbor syndrome; Focal epilepsy with speech disorder with or without mental retardation; Focal segmental glomerulosclerosis 5; Forebrain defects; Frank Ter Haar syndrome; Borrone Di Rocco Crovato syndrome; Frasier syndrome; Wilms tumor 1; Freeman-Sheldon syndrome; Frontometaphyseal dysplasia land 3; Frontotemporal dementia; Frontotemporal dementia and/or amyotrophic lateral sclerosis 3 and 4; Frontotemporal Dementia Chromosome 3-Linked and Frontotemporal dementia ubiquitin-positive; Fructose-biphosphatase deficiency; Fuhrmann syndrome; Gamma-aminobutyric acid transaminase deficiency; Gamstorp-Wohlfart syndrome; Gaucher disease type 1 and Subacute neuronopathic; Gaze palsy, familial horizontal, with progressive scoliosis; Generalized dominant dystrophic epidermolysis bullosa; Generalized epilepsy with febrile seizures plus 3, type 1, type 2; Epileptic encephalopathy Lennox-Gastaut type; Giant axonal neuropathy; Glanzmann thrombasthenia; Glaucoma 1, open angle, e, F, and G; Glaucoma 3, primary congenital, d; Glaucoma, congenital and Glaucoma, congenital, Coloboma; Glaucoma, primary open angle, juvenile-onset; Glioma susceptibility 1; Glucose transporter type 1 deficiency syndrome; Glucose-6-phosphate transport defect; GLUT1 deficiency syndrome 2; Epilepsy, idiopathic generalized, susceptibility to, 12; Glutamate formiminotransferase deficiency; Glutaric acidemia IIA and IIB; Glutaric aciduria, type 1; Gluthathione synthetase deficiency; Glycogen storage disease 0 (muscle), II (adult form), IXa2, IXc, type 1A; type II, type IV, IV (combined hepatic and myopathic), type V, and type VI; Goldmann-Favre syndrome; Gordon syndrome; Gorlin syndrome; Holoprosencephaly sequence; Holoprosencephaly 7; Granulomatous disease, chronic, X-linked, variant; Granulosa cell tumor of the ovary; Gray platelet syndrome; Griscelli syndrome type 3; Groenouw corneal dystrophy type I; Growth and mental retardation, mandibulofacial dysostosis, microcephaly, and cleft palate; Growth hormone deficiency with pituitary anomalies; Growth hormone insensitivity with immunodeficiency; GTP cyclohydrolase I deficiency; Hajdu-Cheney syndrome; Hand foot uterus syndrome; Hearing impairment; Hemangioma, capillary infantile; Hematologic neoplasm; Hemochromatosis type 1, 2B, and 3; Microvascular complications of diabetes 7; Transferrin serum level quantitative trait locus 2; Hemoglobin H disease, nondeletional; Hemolytic anemia, nonspherocytic, due to glucose phosphate isomerase deficiency; Hemophagocytic lymphohistiocytosis, familial, 2; Hemophagocytic lymphohistiocytosis, familial, 3; Heparin cofactor II deficiency; Hereditary acrodermatitis enteropathica; Hereditary breast and ovarian cancer syndrome; Ataxia-telangiectasia-like disorder; Hereditary diffuse gastric cancer; Hereditary diffuse leukoencephalopathy with spheroids; Hereditary factors II, IX, VIII deficiency disease; Hereditary hemorrhagic telangiectasia type 2; Hereditary insensitivity to pain with anhidrosis; Hereditary lymphedema type I; Hereditary motor and sensory neuropathy with optic atrophy; Hereditary myopathy with early respiratory failure; Hereditary neuralgic amyotrophy; Hereditary Nonpolyposis Colorectal Neoplasms; Lynch syndrome I and II; Hereditary pancreatitis; Pancreatitis, chronic, susceptibility to; Hereditary sensory and autonomic neuropathy type IIB amd IIA; Hereditary sideroblastic anemia; Hermansky-Pudlak syndrome 1, 3, 4, and 6; Heterotaxy, visceral, 2, 4, and 6, autosomal; Heterotaxy, visceral, X-linked; Heterotopia; Histiocytic medullary reticulosis; Histiocytosis-lymphadenopathy plus syndrome; Holocarboxylase synthetase deficiency; Holoprosencephaly 2, 3,7, and 9; Holt-Oram syndrome; Homocysteinemia due to MTHFR deficiency, CBS deficiency, and Homocystinuria, pyridoxine-responsive; Homocystinuria-Megaloblastic anemia due to defect in cobalamin metabolism, cblE complementation type; Howel-Evans syndrome; Hurler syndrome; Hutchinson-Gilford syndrome; Hydrocephalus; Hyperammonemia, type III; Hypercholesterolaemia and Hypercholesterolemia, autosomal recessive; Hyperekplexia 2 and Hyperekplexia hereditary; Hyperferritinemia cataract syndrome; Hyperglycinuria; Hyperimmunoglobulin D with periodic fever; Mevalonic aciduria; Hyperimmunoglobulin E syndrome; Hyperinsulinemic hypoglycemia familial 3, 4, and 5; Hyperinsulinism-hyperammonemia syndrome; Hyperlysinemia; Hypermanganesemia with dystonia, polycythemia and cirrhosis; Hyperornithinemia-hyperammonemia-homocitrullinuria syndrome; Hyperparathyroidism 1 and 2; Hyperparathyroidism, neonatal severe; Hyperphenylalaninemia, bh4-deficient, a, due to partial pts deficiency, BH4-deficient, D, and non-pku; Hyperphosphatasia with mental retardation syndrome 2, 3, and 4; Hypertrichotic osteochondrodysplasia; Hypobetalipoproteinemia, familial, associated with apob32; Hypocalcemia, autosomal dominant 1; Hypocalciuric hypercalcemia, familial, types 1 and 3; Hypochondrogenesis; Hypochromic microcytic anemia with iron overload; Hypoglycemia with deficiency of glycogen synthetase in the liver; Hypogonadotropic hypogonadism 11 with or without anosmia; Hypohidrotic ectodermal dysplasia with immune deficiency; Hypohidrotic X-linked ectodermal dysplasia; Hypokalemic periodic paralysis 1 and 2; Hypomagnesemia 1, intestinal; Hypomagnesemia, seizures, and mental retardation; Hypomyelinating leukodystrophy 7; Hypoplastic left heart syndrome; Atrioventricular septal defect and common atrioventricular junction; Hypospadias 1 and 2, X-linked; Hypothyroidism, congenital, nongoitrous, 1; Hypotrichosis 8 and 12; Hypotrichosis-lymphedema-telangiectasia syndrome; I blood group system; Ichthyosis bullosa of Siemens; Ichthyosis exfoliativa; Ichthyosis prematurity syndrome; Idiopathic basal ganglia calcification 5; Idiopathic fibrosing alveolitis, chronic form; Dyskeratosis congenita, autosomal dominant, 2 and 5; Idiopathic hypercalcemia of infancy; Immune dysfunction with T-cell inactivation due to calcium entry defect 2; Immunodeficiency 15, 16, 19, 30, 31C, 38, 40, 8, due to defect in cd3-zeta, with hyper IgM type 1 and 2, and X-Linked, with magnesium defect, Epstein-Barr virus infection, and neoplasia; Immunodeficiency-centromeric instability-facial anomalies syndrome 2; Inclusion body myopathy 2 and 3; Nonaka myopathy; Infantile convulsions and paroxysmal choreoathetosis, familial; Infantile cortical hyperostosis; Infantile GM1 gangliosidosis; Infantile hypophosphatasia; Infantile nephronophthisis; Infantile nystagmus, X-linked; Infantile Parkinsonism-dystonia; Infertility associated with multi-tailed spermatozoa and excessive DNA; Insulin resistance; Insulin-resistant diabetes mellitus and acanthosis nigricans; Insulin-dependent diabetes mellitus secretory diarrhea syndrome; Interstitial nephritis, karyomegalic; Intrauterine growth retardation, metaphyseal dysplasia, adrenal hypoplasia congenita, and genital anomalies; Iodotyrosyl coupling defect; IRAK4 deficiency; Iridogoniodysgenesis dominant type and type 1; Iron accumulation in brain; Ischiopatellar dysplasia; Islet cell hyperplasia; Isolated 17,20-lyase deficiency; Isolated lutropin deficiency; Isovaleryl-CoA dehydrogenase deficiency; Jankovic Rivera syndrome; Jervell and Lange-Nielsen syndrome 2; Joubert syndrome 1, 6, 7, 9/15 (digenic), 14, 16, and 17, and Orofaciodigital syndrome xiv; Junctional epidermolysis bullosa gravis of Herlitz; Juvenile GM>1<gangliosidosis; Juvenile polyposis syndrome; Juvenile polyposis/hereditary hemorrhagic telangiectasia syndrome; Juvenile retinoschisis; Kabuki make-up syndrome; Kallmann syndrome 1, 2, and 6; Delayed puberty; Kanzaki disease; Karak syndrome; Kartagener syndrome; Kenny-Caffey syndrome type 2; Keppen-Lubinsky syndrome; Keratoconus 1; Keratosis follicularis; Keratosis palmoplantaris *striata* 1; Kindler syndrome; L-2-hydroxyglutaric aciduria; Larsen syndrome, dominant type; Lattice corneal dystrophy Type III; Leber amaurosis; Zellweger syndrome; Peroxisome biogenesis disorders; Zellweger syndrome spectrum; Leber congenital amaurosis 11, 12, 13, 16, 4, 7, and 9; Leber optic atrophy; Aminoglycoside-induced deafness; Deafness, nonsyndromic sensorineural, mitochondrial; Left ventricular noncompaction 5; Left-right axis malformations; Leigh disease; Mitochondrial short-chain Enoyl-CoA Hydratase 1 deficiency; Leigh syndrome due to mitochondrial complex I deficiency; Leiner disease; Leri Weill dyschondrosteosis; Lethal congenital contracture syndrome 6; Leukocyte adhesion deficiency type I and III; Leukodystrophy, Hypomyelinating, 11 and 6; Leukoencephalopathy with ataxia, with Brainstem and Spinal Cord Involvement and Lactate Elevation, with vanishing white matter, and progressive, with ovarian failure; Leukonychia totalis; Lewy body dementia; Lichtenstein-Knorr Syndrome; Li-Fraumeni syndrome 1; Lig4 syndrome; Limb-girdle muscular dystrophy, type 1B, 2A, 2B, 2D, C1, C5, C9, C14; Congenital muscular dystrophy-dystroglycanopathy with brain and eye anomalies, type A14 and B14; Lipase deficiency combined; Lipid proteinosis; Lipodystrophy, familial partial, type 2 and 3; Lissencephaly 1, 2 (X-linked), 3, 6 (with microcephaly), X-linked; Subcortical laminar heterotopia, X-linked; Liver failure acute infantile; Loeys-Dietz syndrome 1, 2, 3; Long QT syndrome 1, 2, 2/9, 2/5, (digenic), 3, 5 and 5, acquired, susceptibility to; Lung cancer; Lymphedema, hereditary, id; Lymphedema, primary, with myelodysplasia; Lymphoproliferative syndrome 1, 1 (X-linked), and 2; Lysosomal acid lipase deficiency; Macrocephaly, macrosomia, facial dysmorphism syndrome; Macular dystrophy, vitelliform, adult-onset; Malignant hyperthermia susceptibility type 1; Malignant lymphoma, non-Hodgkin; Malignant melanoma; Malignant tumor of prostate; Mandibuloacral dysostosis; Mandibuloacral dysplasia with type A or B lipodystrophy, atypical; Mandibulofacial dysostosis, Treacher Collins type, autosomal recessive; Mannose-binding protein deficiency; Maple syrup urine disease type 1A and type 3; Marden Walker like syndrome; Marfan syndrome; Marinesco-Sj\xc3\xb6gren syndrome; Martsolf syndrome; Maturity-onset diabetes of the young, type 1, type 2, type 11, type 3, and type 9; May-Hegglin anomaly; MYH9 related disorders; Sebastian syndrome; McCune-Albright syndrome; Somatotroph adenoma; Sex cord-stromal tumor; Cushing syndrome; McKusick Kaufman syndrome; McLeod neuroacanthocytosis syndrome; Meckel-Gruber syndrome; Medium-chain acyl-coenzyme A dehydrogenase deficiency; Medulloblastoma; Megalencephalic leukoencephalopathy with subcortical cysts land 2a; Megalencephaly cutis marmorata telangiectatica congenital; PIK3CA Related Overgrowth Spectrum; Megalencephaly-polymicrogyria-polydactyly-hydrocephalus syndrome 2; Megaloblastic anemia, thiamine-responsive, with diabetes mellitus and sensorineural deafness;

Meier-Gorlin syndromes land 4; Melnick-Needles syndrome; Meningioma; Mental retardation, X-linked, 3, 21, 30, and 72; Mental retardation and microcephaly with pontine and cerebellar hypoplasia; Mental retardation X-linked syndromic 5; Mental retardation, anterior maxillary protrusion, and strabismus; Mental retardation, autosomal dominant 12, 13, 15, 24, 3, 30, 4, 5, 6, and 9; Mental retardation, autosomal recessive 15, 44, 46, and 5; Mental retardation, stereotypic movements, epilepsy, and/or cerebral malformations; Mental retardation, syndromic, Claes-Jensen type, X-linked; Mental retardation, X-linked, nonspecific, syndromic, Hedera type, and syndromic, wu type; Merosin deficient congenital muscular dystrophy; Metachromatic leukodystrophy juvenile, late infantile, and adult types; Metachromatic leukodystrophy; Metatrophic dysplasia; Methemoglobinemia types I and 2; Methionine adenosyltransferase deficiency, autosomal dominant; Methylmalonic acidemia with homocystinuria,; Methylmalonic aciduria cblB type,; Methylmalonic aciduria due to methylmalonyl-CoA mutase deficiency; METHYLMALONIC ACIDURIA, mut(0) TYPE; Microcephalic osteodysplastic primordial dwarfism type 2; Microcephaly with or without chorioretinopathy, lymphedema, or mental retardation; Microcephaly, hiatal hernia and nephrotic syndrome; Microcephaly; Hypoplasia of the corpus callosum; Spastic paraplegia 50, autosomal recessive; Global developmental delay; CNS hypomyelination; Brain atrophy; Microcephaly, normal intelligence and immunodeficiency; Microcephaly-capillary malformation syndrome; Microcytic anemia; Microphthalmia syndromic 5, 7, and 9; Microphthalmia, isolated 3, 5, 6, 8, and with coloboma 6; Microspherophakia; Migraine, familial basilar; Miller syndrome; Minicore myopathy with external ophthalmoplegia; Myopathy, congenital with cores; Mitchell-Riley syndrome; mitochondrial 3-hydroxy-3-methylglutaryl-CoA synthase deficiency; Mitochondrial complex I, II, III, III (nuclear type 2, 4, or 8) deficiency; Mitochondrial DNA depletion syndrome 11, 12 (cardiomyopathic type), 2, 4B (MNGIE type), 8B (MNGIE type); Mitochondrial DNA-depletion syndrome 3 and 7, hepatocerebral types, and 13 (encephalomyopathic type); Mitochondrial phosphate carrier and pyruvate carrier deficiency; Mitochondrial trifunctional protein deficiency; Long-chain 3-hydroxyacyl-CoA dehydrogenase deficiency; Miyoshi muscular dystrophy 1; Myopathy, distal, with anterior tibial onset; Mohr-Tranebjaerg syndrome; Molybdenum cofactor deficiency, complementation group A; Mowat-Wilson syndrome; Mucolipidosis III Gamma; Mucopolysaccharidosis type VI, type VI (severe), and type VII; Mucopolysaccharidosis, MPS-I-H/S, MPS-II, MPS-III-A, MPS-III-B, MPS-III-C, MPS-IV-A, MPS-IV-B; Retinitis Pigmentosa 73; Gangliosidosis GM1 type1 (with cardiac involvenment) 3; Multicentric osteolysis nephropathy; Multicentric osteolysis, nodulosis and arthropathy; Multiple congenital anomalies; Atrial septal defect 2; Multiple congenital anomalies-hypotonia-seizures syndrome 3; Multiple Cutaneous and Mucosal Venous Malformations; Multiple endocrine neoplasia, types land 4; Multiple epiphyseal dysplasia 5 or Dominant; Multiple gastrointestinal atresias; Multiple pterygium syndrome Escobar type; Multiple sulfatase deficiency; Multiple synostoses syndrome 3; Muscle AMP deaminase deficiency; Muscle eye brain disease; Muscular dystrophy, congenital, megaconial type; Myasthenia, familial infantile, 1; Myasthenic Syndrome, Congenital, 11, associated with acetylcholine receptor deficiency; Myasthenic Syndrome, Congenital, 17, 2A (slow-channel), 4B (fast-channel), and without tubular aggregates; Myeloperoxidase deficiency; MYH-associated polyposis; Endometrial carcinoma; Myocardial infarction 1; Myoclonic dystonia; Myoclonic-Atonic Epilepsy; Myoclonus with epilepsy with ragged red fibers; Myofibrillar myopathy 1 and ZASP-related; Myoglobinuria, acute recurrent, autosomal recessive; Myoneural gastrointestinal encephalopathy syndrome; Cerebellar ataxia infantile with progressive external ophthalmoplegia; Mitochondrial DNA depletion syndrome 4B, MNGIE type; Myopathy, centronuclear, 1, congenital, with excess of muscle spindles, distal, 1, lactic acidosis, and sideroblastic anemia 1, mitochondrial progressive with congenital cataract, hearing loss, and developmental delay, and tubular aggregate, 2; Myopia 6; Myosclerosis, autosomal recessive; Myotonia congenital; Congenital myotonia, autosomal dominant and recessive forms; Nail-patella syndrome; Nance-Horan syndrome; Nanophthalmos 2; Navajo neurohepatopathy; Nemaline myopathy 3 and 9; Neonatal hypotonia; Intellectual disability; Seizures; Delayed speech and language development; Mental retardation, autosomal dominant 31; Neonatal intrahepatic cholestasis caused by citrin deficiency; Nephrogenic diabetes insipidus, Nephrogenic diabetes insipidus, X-linked; Nephrolithiasis/osteoporosis, hypophosphatemic, 2; Nephronophthisis 13, 15 and 4; Infertility; Cerebello-oculo-renal syndrome (nephronophthisis, oculomotor apraxia and cerebellar abnormalities); Nephrotic syndrome, type 3, type 5, with or without ocular abnormalities, type 7, and type 9; Nestor-Guillermo progeria syndrome; Neu-Laxova syndrome 1; Neurodegeneration with brain iron accumulation 4 and 6; Neuroferritinopathy; Neurofibromatosis, type land type 2; Neurofibrosarcoma; Neurohypophyseal diabetes insipidus; Neuropathy, Hereditary Sensory, Type IC; Neutral 1 amino acid transport defect; Neutral lipid storage disease with myopathy; Neutrophil immunodeficiency syndrome; Nicolaides-Baraitser syndrome; Niemann-Pick disease type C1, C2, type A, and type C1, adult form; Non-ketotic hyperglycinemia; Noonan syndrome 1 and 4, LEOPARD syndrome 1; Noonan syndrome-like disorder with or without juvenile myelomonocytic leukemia; Normokalemic periodic paralysis, potassium-sensitive; Norum disease; Epilepsy, Hearing Loss, And Mental Retardation Syndrome; Mental Retardation, X-Linked 102 and syndromic 13; Obesity; Ocular albinism, type I; Oculocutaneous albinism type 1B, type 3, and type 4; Oculodentodigital dysplasia; Odontohypophosphatasia; Odontotrichomelic syndrome; Oguchi disease; Oligodontia-colorectal cancer syndrome; Opitz G/BBB syndrome; Optic atrophy 9; Oral-facial-digital syndrome; Ornithine aminotransferase deficiency; Orofacial cleft 11 and 7, Cleft lip/palate-ectodermal dysplasia syndrome; Orstavik Lindemann Solberg syndrome; Osteoarthritis with mild chondrodysplasia; Osteochondritis dissecans; Osteogenesis imperfecta type 12, type 5, type 7, type 8, type I, type III, with normal sclerae, dominant form, recessive perinatal lethal; Osteopathia *striata* with cranial sclerosis; Osteopetrosis autosomal dominant type 1 and 2, recessive 4, recessive 1, recessive 6; Osteoporosis with pseudoglioma; Oto-palato-digital syndrome, types I and II; Ovarian dysgenesis 1; Ovarioleukodystrophy; Pachyonychia congenita 4 and type 2; Paget disease of bone, familial; Pallister-Hall syndrome; Palmoplantar keratoderma, nonepidermolytic, focal or diffuse; Pancreatic agenesis and congenital heart disease; Papillon-Lef\xc3\xa8vre syndrome; Paragangliomas 3; Paramyotonia congenita of von Eulenburg; Parathyroid carcinoma; Parkinson disease 14, 15, 19 (juvenile-onset), 2, 20 (early-onset), 6, (autosomal recessive early-onset, and 9; Partial albinism; Partial hypoxanthine-guanine phosphoribosyltransferase deficiency; Patterned dystrophy of retinal pigment epithelium; PC-K6a; Pelizaeus-Merzbacher disease; Pendred syndrome; Peripheral demyelinating neuropathy, central dysmyelination; Hirschsprung disease; Permanent neonatal diabetes mellitus; Diabetes mellitus, permanent neonatal, with neurologic features; Neonatal insulin-dependent diabetes mellitus; Maturity-onset diabetes of the young, type 2; Peroxisome biogenesis disorder 14B, 2A, 4A, 5B, 6A, 7A, and 7B; Perrault syndrome 4; Perry syndrome; Persistent hyperinsulinemic hypoglycemia of infancy; familial hyperinsulinism; Phenotypes; Phenylketonuria; Pheochromocytoma; Hereditary Paraganglioma-Pheochromocytoma Syndromes; Paragangliomas 1; Carcinoid tumor of intestine; Cowden syndrome 3; Phosphoglycerate dehydrogenase deficiency; Phosphoglycerate kinase 1 deficiency; Photosensitive trichothiodystrophy; Phytanic acid storage disease; Pick disease; Pierson syndrome; Pigmentary retinal dystrophy; Pigmented nodular adrenocortical disease, primary, 1; Pilomatrixoma; Pitt-Hopkins syndrome; Pituitary dependent hypercortisolism; Pituitary hormone deficiency, combined 1, 2, 3, and 4; Plasminogen activator inhibitor type 1 deficiency; Plasminogen deficiency, type I; Platelet-type bleeding disorder 15 and 8; Poikiloderma, hereditary fibrosing, with tendon contractures, myopathy, and pulmonary fibrosis; Polycystic kidney disease 2, adult type, and infantile type; Polycystic lipomembranous osteodysplasia with sclerosing leukoencephalopathy; Polyglucosan body myopathy 1 with or without immunodeficiency; Polymicrogyria, asymmetric, bilateral frontoparietal; Polyneuropathy, hearing loss, ataxia, retinitis pigmentosa, and cataract; Pontocerebellar hypoplasia type 4; Popliteal pterygium syndrome; Porencephaly 2; Porokeratosis 8, disseminated superficial actinic type; Porphobilinogen synthase deficiency; *Porphyria* cutanea *tarda*; Posterior column ataxia with retinitis pigmentosa; Posterior polar cataract type 2; Prader-Willi-like syndrome; Premature ovarian failure 4, 5, 7, and 9; Primary autosomal recessive microcephaly 10, 2, 3, and 5; Primary ciliary dyskinesia 24; Primary dilated cardiomyopathy; Left ventricular noncompaction 6; 4, Left ventricular noncompaction 10; Paroxysmal atrial fibrillation; Primary hyperoxaluria, type I, type, and type III; Primary hypertrophic osteoarthropathy, autosomal recessive 2; Primary hypomagnesemia; Primary open angle glaucoma juvenile onset 1; Primary pulmonary hypertension; Primrose syndrome; Progressive familial heart block type 1B; Progressive familial intrahepatic cholestasis 2 and 3; Progressive intrahepatic cholestasis; Progressive myoclonus epilepsy with ataxia; Progressive pseudorheumatoid dysplasia; Progressive sclerosing poliodystrophy; Prolidase deficiency; Proline dehydrogenase deficiency; Schizophrenia 4; Properdin deficiency, X-linked; Propionic academia; Proprotein convertase 1/3 deficiency; Prostate cancer, hereditary, 2; Protan defect; Proteinuria; Finnish congenital nephrotic syndrome; *Proteus* syndrome; Breast adenocarcinoma; Pseudoachondroplastic spondyloepiphyseal dysplasia syndrome; Pseudohypoaldosteronism type 1 autosomal dominant and recessive and type 2; Pseudohypoparathyroidism type 1A, Pseudopseudohypoparathyroidism; Pseudoneonatal adrenoleukodystrophy; Pseudoprimary hyperaldosteronism; Pseudoxanthoma elasticum; Generalized arterial calcification of infancy 2; Pseudoxanthoma elasticum-like disorder with multiple coagulation factor deficiency; Psoriasis susceptibility 2; PTEN hamartoma tumor syndrome; Pulmonary arterial hypertension related to hereditary hemorrhagic telangiectasia; Pulmonary Fibrosis And/Or Bone Marrow Failure, Telomere-Related, 1 and 3; Pulmonary hypertension, primary, 1, with hereditary hemorrhagic telangiectasia; Purine-nucleoside phosphorylase deficiency; Pyruvate carboxylase deficiency; Pyruvate dehydrogenase E1-alpha deficiency; Pyruvate kinase deficiency of red cells; Raine syndrome; Rasopathy; Recessive dystrophic epidermolysis bullosa; Nail disorder, nonsyndromic congenital, 8; Reifenstein syndrome; Renal adysplasia; Renal carnitine transport defect; Renal coloboma syndrome; Renal dysplasia; Renal dysplasia, retinal pigmentary dystrophy, cerebellar ataxia and skeletal dysplasia; Renal tubular acidosis, distal, autosomal recessive, with late-onset sensorineural hearing loss, or with hemolytic anemia; Renal tubular acidosis, proximal, with ocular abnormalities and mental retardation; Retinal cone dystrophy 3B; Retinitis pigmentosa; Retinitis pigmentosa 10, 11, 12, 14, 15, 17, and 19; Retinitis pigmentosa 2, 20, 25, 35, 36, 38, 39, 4, 40, 43, 45, 48, 66, 7, 70, 72; Retinoblastoma; Rett disorder; Rhabdoid tumor predisposition syndrome 2; Rhegmatogenous retinal detachment, autosomal dominant; Rhizomelic chondrodysplasia *punctata* type 2 and type 3; Roberts-SC phocomelia syndrome; Robinow Sorauf syndrome; Robinow syndrome, autosomal recessive, autosomal recessive, with brachy-syn-polydactyly; Rothmund-Thomson syndrome; Rapadilino syndrome; RRM2B-related mitochondrial disease; Rubinstein-Taybi syndrome; Salla disease; Sandhoff disease, adult and infantil types; Sarcoidosis, early-onset; Blau syndrome; Schindler disease, type 1; Schizencephaly; Schizophrenia 15; Schneckenbecken dysplasia; Schwannomatosis 2; Schwartz Jampel syndrome type 1; Sclerocornea, autosomal recessive; Sclerosteosis; Secondary hypothyroidism; Segawa syndrome, autosomal recessive; Senior-Loken syndrome 4 and 5,; Sensory ataxic neuropathy, dysarthria, and ophthalmoparesis; Sepiapterin reductase deficiency; SeSAME syndrome; Severe combined immunodeficiency due to ADA deficiency, with microcephaly, growth retardation, and sensitivity to ionizing radiation, atypical, autosomal recessive, T cell-negative, B cell-positive, NK cell-negative of NK-positive; Partial adenosine deaminase deficiency; Severe congenital neutropenia; Severe congenital neutropenia 3, autosomal recessive or dominant; Severe congenital neutropenia and 6, autosomal recessive; Severe myoclonic epilepsy in infancy; Generalized epilepsy with febrile seizures plus, types 1 and 2; Severe X-linked myotubular myopathy; Short QT syndrome 3; Short stature with nonspecific skeletal abnormalities; Short stature, auditory canal atresia, mandibular hypoplasia, skeletal abnormalities; Short stature, onychodysplasia, facial dysmorphism, and hypotrichosis; Primordial dwarfism; Short-rib thoracic dysplasia 11 or 3 with or without polydactyly; Sialidosis type I and II; Silver spastic paraplegia syndrome; Slowed nerve conduction velocity, autosomal dominant; Smith-Lemli-Opitz syndrome; Snyder Robinson syndrome; Somatotroph adenoma; Prolactinoma; familial, Pituitary adenoma predisposition; Sotos syndrome 1 or 2; Spastic ataxia 5, autosomal recessive, Charlevoix-Saguenay type, 1, 10, or 11, autosomal recessive; Amyotrophic lateral sclerosis type 5; Spastic paraplegia 15, 2, 3, 35, 39, 4, autosomal dominant, 55, autosomal recessive, and 5A; Bile acid synthesis defect, congenital, 3; Spermatogenic failure 11, 3, and 8; Spherocytosis types 4 and 5; Spheroid body myopathy; Spinal muscular atrophy, lower extremity predominant 2, autosomal dominant; Spinal muscular atrophy, type II; Spinocerebellar ataxia 14, 21, 35, 40, and 6; Spinocerebellar ataxia autosomal recessive 1 and 16; Splenic hypoplasia; Spondylocarpotarsal synostosis syndrome; Spondylocheirodysplasia, Ehlers-Danlos syndrome-like, with immune dysregulation, Aggrecan type, with congenital joint dislocations, short limb-hand type, Sedaghatian type, with cone-rod dystrophy, and Kozlowski type; Parastremmatic dwarfism; Stargardt disease 1; Cone-rod dystrophy 3; Stickler syndrome type 1;

Kniest dysplasia; Stickler syndrome, types 1(nonsyndromic ocular) and 4; Sting-associated vasculopathy, infantile-onset; Stormorken syndrome; Sturge-Weber syndrome, Capillary malformations, congenital, 1; Succinyl-CoA acetoacetate transferase deficiency; Sucrase-isomaltase deficiency; Sudden infant death syndrome; Sulfite oxidase deficiency, isolated; Supravalvar aortic stenosis; Surfactant metabolism dysfunction, pulmonary, 2 and 3; Symphalangism, proximal, lb; Syndactyly Cenani Lenz type; Syndactyly type 3; Syndromic X-linked mental retardation 16; Talipes equinovarus; Tangier disease; TARP syndrome; Tay-Sachs disease, B1 variant, Gm2-gangliosidosis (adult), Gm2-gangliosidosis (adult-onset); Temtamy syndrome; Tenorio Syndrome; Terminal osseous dysplasia; Testosterone 17-beta-dehydrogenase deficiency; Tetraamelia, autosomal recessive; Tetralogy of Fallot; Hypoplastic left heart syndrome 2; Truncus arteriosus; Malformation of the heart and great vessels; Ventricular septal defect 1; Thiel-Behnke corneal dystrophy; Thoracic aortic aneurysms and aortic dissections; Marfanoid habitus; Three M syndrome 2; Thrombocytopenia, platelet dysfunction, hemolysis, and imbalanced globin synthesis; Thrombocytopenia, X-linked; Thrombophilia, hereditary, due to protein C deficiency, autosomal dominant and recessive; Thyroid agenesis; Thyroid cancer, follicular; Thyroid hormone metabolism, abnormal; Thyroid hormone resistance, generalized, autosomal dominant; Thyrotoxic periodic paralysis and Thyrotoxic periodic paralysis 2; Thyrotropin-releasing hormone resistance, generalized; Timothy syndrome; TNF receptor-associated periodic fever syndrome (TRAPS); Tooth agenesis, selective, 3 and 4; Torsades de pointes; Townes-Brocks-branchiootorenal-like syndrome; Transient bullous dermolysis of the newborn; Treacher collins syndrome 1; Trichomegaly with mental retardation, dwarfism and pigmentary degeneration of retina; Trichorhinophalangeal dysplasia type I; Trichorhinophalangeal syndrome type 3; Trimethylaminuria; Tuberous sclerosis syndrome; Lymphangiomyomatosis; Tuberous sclerosis 1 and 2; Tyrosinase-negative oculocutaneous albinism; Tyrosinase-positive oculocutaneous albinism; Tyrosinemia type I; UDPglucose-4-epimerase deficiency; Ullrich congenital muscular dystrophy; Ulna and fibula absence of with severe limb deficiency; Upshaw-Schulman syndrome; Urocanate hydratase deficiency; Usher syndrome, types 1, 1B, 1D, 1G, 2A, 2C, and 2D; Retinitis pigmentosa 39; UV-sensitive syndrome; Van der Woude syndrome; Van Maldergem syndrome 2; Hennekam lymphangiectasia-lymphedema syndrome 2; Variegate *porphyria*; Ventriculomegaly with cystic kidney disease; Verheij syndrome; Very long chain acyl-CoA dehydrogenase deficiency; Vesicoureteral reflux 8; Visceral heterotaxy 5, autosomal; Visceral myopathy; Vitamin D-dependent rickets, types land 2; Vitelliform dystrophy; von Willebrand disease type 2M and type 3; Waardenburg syndrome type 1, 4C, and 2E (with neurologic involvement); Klein-Waardenberg syndrome; Walker-Warburg congenital muscular dystrophy; Warburg micro syndrome 2 and 4; Warts, hypogammaglobulinemia, infections, and myelokathexis; Weaver syndrome; Weill-Marchesani syndrome 1 and 3; Weill-Marchesani-like syndrome; Weissenbacher-Zweymuller syndrome; Werdnig-Hoffmann disease; Charcot-Marie-Tooth disease; Werner syndrome; WFS1-Related Disorders; Wiedemann-Steiner syndrome; Wilson disease; Wolfram-like syndrome, autosomal dominant; Worth disease; Van Buchem disease type 2; Xeroderma pigmentosum, complementation group b, group D, group E, and group G; X-linked agammaglobulinemia; X-linked hereditary motor and sensory neuropathy; X-linked ichthyosis with steryl-sulfatase deficiency; X-linked periventricular heterotopia; Oto-palato-digital syndrome, type I; X-linked severe combined immunodeficiency; Zimmermann-Laband syndrome and Zimmermann-Laband syndrome 2; and Zonular pulverulent cataract 3.

In some aspects, the present disclosure provides uses of any one of the fusion proteins described herein and a guide RNA targeting this fusion protein to a target A:T base pair in a nucleic acid molecule in the manufacture of a kit for base editing, wherein the base editing comprises contacting the nucleic acid molecule with the fusion protein and guide RNA under conditions suitable for the substitution of the adenine (A) of the A:T nucleobase pair with a guanine (G). In some embodiments of these uses, the nucleic acid molecule is a double-stranded DNA molecule. In some embodiments, the step of contacting of induces separation of the double-stranded DNA at a target region. In some embodiments, the step of contacting further comprises nicking one strand of the double-stranded DNA, wherein the one strand comprises an unmutated strand that comprises the T of the target A:T nucleobase pair.

In some embodiments of the described uses, the step of contacting is performed in vitro. In other embodiments, the step of contacting is performed in vivo. In some embodiments, the step of contacting is performed in a subject (e.g., a human subject or a non-human animal subject). In some embodiments, the step of contacting is performed in a cell, such as a human or non-human animal cell.

The present disclosure also provides uses of any one of the fusion proteins described herein as a medicament. The present disclosure also provides uses of any one of the complexes of fusion proteins and guide RNAs described herein as a medicament.

Pharmaceutical Compositions

Other aspects of the present disclosure relate to pharmaceutical compositions comprising any of the adenosine deaminases, fusion proteins, or the fusion protein-gRNA complexes described herein. The term "pharmaceutical composition", as used herein, refers to a composition formulated for pharmaceutical use. In some embodiments, the pharmaceutical composition further comprises a pharmaceutically acceptable carrier. In some embodiments, the pharmaceutical composition comprises additional agents (e.g. for specific delivery, increasing half-life, or other therapeutic compounds).

In some embodiments, any of the fusion proteins, gRNAs, and/or complexes described herein are provided as part of a pharmaceutical composition. In some embodiments, the pharmaceutical composition comprises any of the fusion proteins provided herein. In some embodiments, the pharmaceutical composition comprises any of the complexes provided herein. In some embodiments pharmaceutical composition comprises a gRNA, a napDNAbp-dCas9 fusion protein, and a pharmaceutically acceptable excipient. In some embodiments pharmaceutical composition comprises a gRNA, a napDNAbp-nCas9 fusion protein, and a pharmaceutically acceptable excipient. Pharmaceutical compositions may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with a any of the pharmaceutical compositions provided herein. In some embodiments, cells removed from a subject and contacted ex vivo with a pharmaceutical composition are re-introduced into the subject, optionally after the desired genomic modification has been effected or detected in the cells. Methods of delivering pharmaceutical compositions comprising nucleases are known, and are described, for example, in U.S. Pat. Nos. 6,453,242; 6,503,717; 6,534,261; 6,599,692; 6,607,882; 6,689,558; 6,824,978; 6,933,113; 6,979,539; 7,013,219; and 7,163,824, the disclosures of all of which are incorporated by reference herein in their entireties. Although the descriptions of pharmaceutical compositions provided herein are principally directed to pharmaceutical compositions which are suitable for administration to humans, it will be understood by the skilled artisan that such compositions are generally suitable for administration to animals or organisms of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, domesticated animals, pets, and commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient(s) into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's The Science and Practice of Pharmacy, 21st Edition, A. R. Gennaro (Lippincott, Williams & Wilkins, Baltimore, MD, 2006; incorporated in its entirety herein by reference) discloses various excipients used in formulating pharmaceutical compositions and known techniques for the preparation thereof. See also PCT application PCT/US2010/055131 (Publication No. WO/2011053982), filed Nov. 2, 2010, incorporated in its entirety herein by reference, for additional suitable methods, reagents, excipients and solvents for producing pharmaceutical compositions comprising a nuclease. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this disclosure.

As used herein, the term "pharmaceutically-acceptable carrier" means a pharmaceutically-acceptable material, composition or vehicle, such as a liquid or solid filler, diluent, excipient, manufacturing aid (e.g., lubricant, talc magnesium, calcium or zinc stearate, or steric acid), or solvent encapsulating material, involved in carrying or transporting the compound from one site (e.g., the delivery site) of the body, to another site (e.g., organ, tissue or portion of the body). A pharmaceutically acceptable carrier is "acceptable" in the sense of being compatible with the other ingredients of the formulation and not injurious to the tissue of the subject (e.g., physiologically compatible, sterile, physiologic pH, etc.). Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, methylcellulose, ethyl cellulose, microcrystalline cellulose and cellulose acetate; (4) powdered tragacanth; (5) malt; (6) gelatin; (7) lubricating agents, such as magnesium stearate, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol (PEG); (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates and/or polyanhydrides; (22) bulking agents, such as polypeptides and amino acids (23) serum component, such as serum albumin, HDL and LDL; (22) C2-C12 alcohols, such as ethanol; and (23) other non-toxic compatible substances employed in pharmaceutical formulations. Wetting agents, coloring agents, release agents, coating agents, sweetening agents, flavoring agents, perfuming agents, preservative and antioxidants can also be present in the formulation. The terms such as "excipient", "carrier", "pharmaceutically acceptable carrier" or the like are used interchangeably herein.

In some embodiments, the pharmaceutical composition is formulated for delivery to a subject, e.g., for gene editing. Suitable routes of administrating the pharmaceutical composition described herein include, without limitation: topical, subcutaneous, transdermal, intradermal, intralesional, intraarticular, intraperitoneal, intravesical, transmucosal, gingival, intradental, intracochlear, transtympanic, intraorgan, epidural, intrathecal, intramuscular, intravenous, intravascular, intraosseus, periocular, intratumoral, intracerebral, and intracerebroventricular administration.

In some embodiments, the pharmaceutical composition described herein is administered locally to a diseased site (e.g., tumor site). In some embodiments, the pharmaceutical composition described herein is administered to a subject by injection, by means of a catheter, by means of a suppository, or by means of an implant, the implant being of a porous, non-porous, or gelatinous material, including a membrane, such as a sialastic membrane, or a fiber.

In other embodiments, the pharmaceutical composition described herein is delivered in a controlled release system. In one embodiment, a pump may be used (see, e.g., Langer, 1990, *Science* 249:1527-1533; Sefton, 1989, *CRC Crit. Ref. Biomed. Eng.* 14:201; Buchwald et al., 1980, *Surgery* 88:507; Saudek et al., 1989, *N. Engl. J. Med.* 321:574). In another embodiment, polymeric materials may be used. (See, e.g., Medical Applications of Controlled Release (Langer and Wise eds., CRC Press, Boca Raton, Fla., 1974); Controlled Drug Bioavailability, Drug Product Design and Performance (Smolen and Ball eds., Wiley, New York, 1984); Ranger and Peppas, 1983, *Macromol. Sci. Rev. Macromol. Chem.* 23:61. See also Levy et al., 1985, *Science* 228:190; During et al., 1989, *Ann. Neurol.* 25:351; Howard et al., 1989, *J. Neurosurg.* 71:105.) Other controlled release systems are discussed, for example, in Langer, supra.

In some embodiments, the pharmaceutical composition is formulated in accordance with routine procedures as a composition adapted for intravenous or subcutaneous administration to a subject, e.g., a human. In some embodiments, pharmaceutical composition for administration by injection are solutions in sterile isotonic aqueous buffer. Where necessary, the pharmaceutical can also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the pharmaceutical is to be administered by infusion, it can be dispensed with an infusion bottle containing sterile pharmaceutical grade water or saline. Where the pharmaceutical composition is administered by injection, an ampoule of sterile water for injection or saline can be provided so that the ingredients can be mixed prior to administration.

A pharmaceutical composition for systemic administration may be a liquid, e.g., sterile saline, lactated Ringer's or Hank's solution. In addition, the pharmaceutical composition can be in solid forms and re-dissolved or suspended immediately prior to use. Lyophilized forms are also contemplated.

The pharmaceutical composition may be contained within a lipid particle or vesicle, such as a liposome or microcrystal, which is also suitable for parenteral administration. The particles may be of any suitable structure, such as unilamellar or plurilamellar, so long as compositions are contained therein. Compounds may be entrapped in "stabilized plasmid-lipid particles" (SPLP) containing the fusogenic lipid dioleoylphosphatidylethanolamine (DOPE), low levels (5-10 mol %) of cationic lipid, and stabilized by a polyethyleneglycol (PEG) coating (Zhang Y. P. et al., *Gene Ther.* 1999, 6:1438-47). Positively charged lipids such as N-[1-(2,3-dioleoyloxi)propyl]-N,N,N-trimethyl-amoniummethylsulfate, or "DOTAP," are particularly preferred for such particles and vesicles. The preparation of such lipid particles is well known. See, e.g., U.S. Pat. Nos. 4,880,635; 4,906,477; 4,911,928; 4,917,951; 4,920,016; and 4,921,757; each of which is incorporated herein by reference.

The pharmaceutical composition described herein may be administered or packaged as a unit dose, for example. The term "unit dose" when used in reference to a pharmaceutical composition of the present disclosure refers to physically discrete units suitable as unitary dosage for the subject, each unit containing a predetermined quantity of active material calculated to produce the desired therapeutic effect in association with the required diluent; i.e., carrier, or vehicle.

Further, the pharmaceutical composition may be provided as a pharmaceutical kit comprising (a) a container containing a compound of the disclosure in lyophilized form and (b) a second container containing a pharmaceutically acceptable diluent (e.g., sterile water) for injection. The pharmaceutically acceptable diluent may be used for reconstitution or dilution of the lyophilized compound of the disclosure. Optionally associated with such container(s) may be a notice in the form prescribed by a governmental agency regulating the manufacture, use or sale of pharmaceuticals or biological products, which notice reflects approval by the agency of manufacture, use or sale for human administration.

In another aspect, an article of manufacture containing materials useful for the treatment of the diseases described above is included. In some embodiments, the article of manufacture comprises a container and a label. Suitable containers include, for example, bottles, vials, syringes, and test tubes. The containers may be formed from a variety of materials such as glass or plastic. In some embodiments, the container holds a composition that is effective for treating a disease described herein and may have a sterile access port. For example, the container may be an intravenous solution bag or a vial having a stopper pierceable by a hypodermic injection needle. The active agent in the composition is a compound of the disclosure. In some embodiments, the label on or associated with the container indicates that the composition is used for treating the disease of choice. The article of manufacture may further comprise a second container comprising a pharmaceutically-acceptable buffer, such as phosphate-buffered saline, Ringer's solution, or dextrose solution. It may further include other materials desirable from a commercial and user standpoint, including other buffers, diluents, filters, needles, syringes, and package inserts with instructions for use.

Delivery Methods

In some aspects, the disclosure provides methods comprising delivering one or more polynucleotides, such as or one or more vectors as described herein, one or more transcripts thereof, and/or one or proteins transcribed therefrom, to a host cell. In some aspects, the disclosure further provides cells produced by such methods, and organisms (such as animals, plants, or fungi) comprising or produced from such cells. In some embodiments, a base editor as described herein in combination with (and optionally complexed with) a guide sequence is delivered to a cell.

In some embodiments, the method of delivery provided comprises nucleofection, microinjection, biolistics, virosomes, liposomes, immunoliposomes, polycation or lipid: nucleic acid conjugates, naked DNA, artificial virions, and agent-enhanced uptake of DNA.

Conventional viral and non-viral based gene transfer methods may be used to introduce nucleic acids in mammalian cells or target tissues. Such methods may be used to administer nucleic acids encoding components of a base editor to cells in culture, or in a host organism. Non-viral vector delivery systems include ribonucleoprotein (RNP) complexes, DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, *Science* 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, *Nature* 357:455-460 (1992); Van Brunt, Biotechnology 6(10):1149-1154 (1988); Vigne, *Restorative Neurology and Neuroscience* 8:35-36 (1995); Kremer & Perricaudet, *British Medical Bulletin* 51(1):31-44 (1995); Haddada et al., in *Current Topics in Microbiology and Immunology* Doerfler and Bihm (eds) (1995); and Yu et al., *Gene Therapy* 1:13-26 (1994).

In certain embodiments, the method of delivery and vector provided herein is an RNP complex. RNP delivery of base editors markedly increases the DNA specificity of base editing. RNP delivery of base editors leads to decoupling of on- and off-target editing. RNP delivery ablated off-target editing at non-repetitive sites while maintaining on-target editing comparable to plasmid delivery, and greatly reduced off-target editing even at the highly repetitive VEGFA site 2. See Rees, H. A. et al., Improving the DNA specificity and applicability of base editing through protein engineering and protein delivery, *Nat. Commun.* 8, 15790 (2017), which is incorporated by reference herein in its entirety.

Methods of non-viral delivery of nucleic acids include RNP complexes, include lipofection, nucleofection, electoporation, stable genome integration (e.g., piggybac), microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™, Lipofectin™ and SF Cell Line 4D-Nucleofector X Kit™ (Lonza)). Cationic and neutral lipids that are suitable for efficient receptor-recognition lipofection of polynucleotides include those of Feigner, WO 91/17424; WO 91/16024. Delivery may be to cells (e.g. in vitro or ex vivo administration) or target tissues (e.g. in vivo administration). Delivery may be achieved through the use of RNP complexes.

The preparation of lipid:nucleic acid complexes, including targeted liposomes such as immunolipid complexes, is well known to one of skill in the art (see, e.g., Crystal, *Science* 270:404-410 (1995); Blaese et al., *Cancer Gene Ther.* 2:291-297 (1995); Behr et al., *Bioconjugate Chem.* 5:382-389 (1994); Remy et al., *Bioconjugate Chem.* 5:647-654 (1994); Gao et al., *Gene Therapy* 2:710-722 (1995); Ahmad et al., *Cancer Res.* 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors may be administered directly to patients (in vivo) or they may be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a viruses can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., *J. Virol.* 66:2731-2739 (1992); Johann et al., *J. Virol.* 66:1635-1640 (1992); Sommnerfelt et al., *Virol.* 176:58-59 (1990); Wilson et al., *J. Virol.* 63:2374-2378 (1989); Miller et al., *J. Virol.* 65:2220-2224 (1991); PCT/US94/05700). In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., *Virology* 160:38-47 (1987); U.S. Pat. No. 4,797,368; WO 93/24641; Kotin, *Human Gene Therapy* 5:793-801 (1994); Muzyczka, *J. Clin. Invest.* 94:1351 (1994). Construction of recombinant AAV vectors are described in a number of publications, including U.S. Pat. No. 5,173,414; Tratschin et al., *Mol. Cell. Biol.* 5:3251-3260 (1985); Tratschin, et al., *Mol. Cell. Biol.* 4:2072-2081 (1984); Hermonat & Muzyczka, *PNAS* 81:6466-6470 (1984); and Samulski et al., *J. Virol.* 63:03822-3828 (1989).

Packaging cells are typically used to form virus particles that are capable of infecting a host cell. Such cells include 293 cells, which package adenovirus, and ψ2 cells or PA317 cells, which package retrovirus. Viral vectors used in gene therapy are usually generated by producing a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also be infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Additional methods for the delivery of nucleic acids to cells are known to those skilled in the art. Reference is made to US 2003/0087817, published May 8, 2003, International Patent Application No. WO 2016/205764, published Dec. 22, 2016, International Patent Application No. WO 2018/071868, published Apr. 19, 2018, and U.S. Patent Publication No. 2018/0127780, published May 10, 2018, the disclosures of each of which are incorporated herein by reference.

In various embodiments, the disclosed expression constructs may be engineered for delivery in one or more rAAV vectors. An rAAV as related to any of the methods and compositions provided herein may be of any serotype including any derivative or pseudotype (e.g., 1, 2, 3, 4, 5, 6, 7, 8, 9, 10, 11, 12, 13, 2/1, 2/5, 2/8, 2/9, 3/1, 3/5, 3/8, or 3/9). An rAAV may comprise a genetic load (i.e., a recombinant nucleic acid vector that expresses a gene of interest, such as a whole or split fusion protein that is carried by the rAAV into a cell) that is to be delivered to a cell. An rAAV may be chimeric.

As used herein, the serotype of an rAAV refers to the serotype of the capsid proteins of the recombinant virus. Non-limiting examples of derivatives and pseudotypes include rAAV2/1, rAAV2/5, rAAV2/8, rAAV2/9, AAV2-AAV3 hybrid, AAVrh.10, AAVhu.14, AAV3a/3b, AAVrh32.33, AAV-HSC15, AAV-HSC17, AAVhu.37, AAVrh.8, CHt-P6, AAV2.5, AAV6.2, AAV2i8, AAV-HSC15/17, AAVM41, AAV9.45, AAV6(Y445F/Y731F), AAV2.5T, AAV-HAE1/2, AAV clone 32/83, AAVShH10, AAV2 (Y→F), AAV8 (Y733F), AAV2.15, AAV2.4, AAVM41, and AAVr3.45. A non-limiting example of derivatives and pseudotypes that have chimeric VP1 proteins is rAAV2/5-1VP1u, which has the genome of AAV2, capsid backbone of AAV5 and VP1u of AAV1. Other non-limiting example of derivatives and pseudotypes that have chimeric VP1 proteins are rAAV2/5-8VP1u, rAAV2/9-1VP1u, and rAAV2/9-8VP1u.

AAV derivatives/pseudotypes, and methods of producing such derivatives/pseudotypes are known in the art (see, e.g., *Mol Ther.* 2012 April; 20(4):699-708. doi: 10.1038/mt.2011.287. Epub 2012 Jan. 24. The AAV vector toolkit: poised at the clinical crossroads. Asokan Al, Schaffer D V, Samulski R J.). Methods for producing and using pseudotyped rAAV vectors are known in the art (see, e.g., Duan et al., *J. Virol.,* 75:7662-7671, 2001; Halbert et al., *J. Virol.,* 74:1524-1532, 2000; Zolotukhin et al., *Methods,* 28:158-167, 2002; and Auricchio et al., *Hum. Molec. Genet.,* 10:3075-3081, 2001).

Methods of making or packaging rAAV particles are known in the art and reagents are commercially available (see, e.g., Zolotukhin et al. Production and purification of serotype 1, 2, and 5 recombinant adeno-associated viral vectors. Methods 28 (2002) 158-167; and U.S. Patent Publication Numbers US20070015238 and US20120322861, which are incorporated herein by reference; and plasmids and kits available from ATCC and Cell Biolabs, Inc.). For example, a plasmid comprising a gene of interest may be combined with one or more helper plasmids, e.g., that contain a rep gene (e.g., encoding Rep78, Rep68, Rep52 and Rep40) and a cap gene (encoding VP1, VP2, and VP3, including a modified VP2 region as described herein), and transfected into a recombinant cells such that the rAAV particle can be packaged and subsequently purified.

In some embodiments, the fusion proteins can be divided at a split site and provided as two halves of a whole/complete fusion protein. The two halves can be delivered to cells (e.g., as expressed proteins or on separate expression vectors) and once in contact inside the cell, the two halves form the complete fusion protein through the self-splicing action of the inteins on each fusion protein half. Split intein sequences can be engineered into each of the halves of the encoded fusion protein to facilitate their transplicing inside the cell and the concomitant restoration of the complete, functioning ABE.

These split intein-based methods overcome several barriers to in vivo delivery. For example, the DNA encoding fusion proteins is larger than the recombinant AAV (rAAV) packaging limit, and so requires different solutions. One such solution is formulating the editor fused to split intein pairs that are packaged into two separate rAAV particles that, when co-delivered to a cell, reconstitute the functional editor protein. Several other special considerations to account for the unique features of base editing are described, including the optimization of second-site nicking targets and properly packaging fusion proteins into virus vectors, including lentiviruses and rAAV.

Accordingly, the disclosure provides dual rAAV vectors and dual rAAV vector particles that comprise expression constructs that encode two halves of any of the disclosed fusion proteins, wherein the encoded fusion protein is divided between the two halves at a split site. In some embodiments, the two halves may be delivered to cells (e.g., as expressed proteins or on separate expression vectors) and once in contact inside the cell, the two halves form the complete fusion protein through the self-splicing action of the inteins on each fusion protein half. Split intein sequences can be engineered into each of the halves of the encoded fusion protein to facilitate their transplicing inside the cell and the concomitant restoration of the complete, functioning ABE.

In various embodiments, the fusion proteins may be engineered as two half proteins (i.e., an ABE N-terminal half and a ABE C-terminal half) by "splitting" the whole fusion protein as a "split site." The "split site" refers to the location of insertion of split intein sequences (i.e., the N intein and the C intein) between two adjacent amino acid residues in the fusion protein. More specifically, the "split site" refers to the location of dividing the whole fusion protein into two separate halves, wherein in each halve is fused at the split site to either the N intein or the C intein motifs. The split site can be at any suitable location in the fusion protein fusion protein, but preferably the split site is located at a position that allows for the formation of two half proteins which are appropriately sized for delivery (e.g., by expression vector) and wherein the inteins, which are fused to each half protein at the split site termini, are available to sufficiently interact with one another when one half protein contacts the other half protein inside the cell.

Additional methods for the delivery of nucleic acids to cells are known to those skilled in the art. See, for example, US 2003/0087817, incorporated herein by reference, It should be appreciated that any fusion protein, e.g., any of the fusion proteins provided herein, may be introduced into the cell in any suitable way, either stably or transiently. In some embodiments, a fusion protein may be transfected into the cell. In some embodiments, the cell may be transduced or transfected with a nucleic acid construct that encodes a fusion protein. For example, a cell may be transduced (e.g., with a virus encoding a fusion protein), or transfected (e.g., with a plasmid encoding a fusion protein) with a nucleic acid that encodes a fusion protein, or the translated fusion protein. Such transduction may be a stable or transient transduction. In some embodiments, cells expressing a fusion protein or containing a fusion protein may be transduced or transfected with one or more gRNA molecules, for example when the fusion protein comprises a Cas9 (e.g., nCas9) domain. In some embodiments, a plasmid expressing a fusion protein may be introduced into cells through electroporation, transient (e.g., lipofection) and stable genome integration (e.g., piggybac) and viral transduction or other methods known to those of skill in the art.

Kits and Cells

This disclosure provides kits comprising a nucleic acid construct comprising nucleotide sequences encoding the fusion proteins, gRNAs, and/or complexes described herein. Some embodiments of this disclosure provide kits comprising a nucleic acid construct comprising a nucleotide sequence encoding an adenosine deaminase-napDNAbp fusion protein capable of deaminating an adenosine in a nucleic acid molecule. In some embodiments, the nucleotide sequence encodes any of the adenosine deaminases provided herein. In some embodiments, the nucleotide sequence comprises a heterologous promoter that drives expression of the adenosine deaminase. The nucleotide sequence may further comprise a heterologous promoter that drives expression of the gRNA, or a heterologous promoter that drives expression of the fusion protein and the gRNA.

In some embodiments, the kit further comprises an expression construct encoding a guide nucleic acid backbone, e.g., a guide RNA backbone, wherein the construct comprises a cloning site positioned to allow the cloning of a nucleic acid sequence identical or complementary to a target sequence into the guide nucleic acid, e.g., guide RNA backbone.

The disclosure further provides kits comprising a fusion protein as provided herein, a gRNA having complementarity to a target sequence, and one or more of the following:

cofactor proteins, buffers, media, and target cells (e.g., human cells). Kits may comprise combinations of several or all of the aforementioned components.

Some embodiments of this disclosure provide kits comprising a nucleic acid construct, comprising (a) a nucleotide sequence encoding a napDNAbp (e.g., a Cas9 domain) fused to an adenosine deaminase domain; and (b) a heterologous promoter that drives expression of the sequence of (a). In some embodiments, the kit further comprises an expression construct encoding a guide nucleic acid backbone, e.g., a guide RNA backbone, wherein the construct comprises a cloning site positioned to allow the cloning of a nucleic acid sequence identical or complementary to a target sequence into the guide nucleic acid, e.g., guide RNA backbone.

Some embodiments of this disclosure provide cells comprising any of the fusion proteins or complexes provided herein. In some embodiments, the cells comprise nucleotide constructs that encodes any of the fusion proteins provided herein. In some embodiments, the cells comprise any of the nucleotides or vectors provided herein. In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art.

In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huhl, Huh4, Huh7, HUVEC, HASMC, HEKn, HEKa, MiaPaCell, Pancl, PC-3, TF1, CTLL-2, ClR, Rat6, CV1, RPTE, A10, T24, J82, A375, ARH-77, Calul, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A 172, A20, A253, A431, A-549, ALC, B16, B35, BCP-1 cells, BEAS-2B, bEnd.3, BHK-21, BR 293. BxPC3. C3H-10T1/2, C6/36, Cal-27, CHO, CHO-7, CHO-IR, CHO-K1, CHO-K2, CHO-T, CHO Dhfr -/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepalclc7, HL-60, HMEC, HT-29, Jurkat, JY cells, K562 cells, Ku812, KCL22, KGi, KYO1, LNCap, Ma-Mel 1-48, MC-38, MCF-7, MCF-10A, MDA-MB-231, MDA-MB-468, MDA-MB-435, MDCK II, MDCK 11, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In the Examples discussed below, the widespread, low-level cellular RNA editing from adenine base editors was identified, that was greatly reduced, without substantially sacrificing on-target DNA editing, by introducing the E59A or E59Q mutation into TadA and the V106W mutation in TadA*. In addition to decoupling DNA and RNA editing activities, the ABEmaxAW variant substantially reduced off-target DNA editing activity and the formation of indel byproducts. Although it is noted that even ABEmax-mediated RNA editing is both low-level (averaging 0.21% across all transcripts) and transient given the short half-life of most cellular RNAs (27, 29), the extent to which low-level RNA editing may interfere with base editing biological studies or therapeutics development efforts will depend strongly on features of the specific applications, including the duration of exposure to the base editor. It is recommended that researchers use ABEmaxAW or ABEmaxQW for adenine base editing applications that require minimizing RNA editing, off-target DNA editing, and/or indel formation.

It should be appreciated that the foregoing concepts, and additional concepts discussed below, may be arranged in any suitable combination, as the present disclosure is not limited in this respect. Further, other advantages and novel features of the present disclosure will become apparent from the following detailed description of various non-limiting embodiments when considered in conjunction with the accompanying figures.

EXAMPLES

Example 1

HEK293T cells were transfected with a plasmid expressing ABEmax and isolating genomic DNA and RNA after 48 hours. After cDNA generation from poly-adenylated cellular mRNA, high-throughput sequencing (HTS) was performed on 220- to 250-nt regions of three mRNA amplicons: CTNNB1, IP90, and RSL1D1. CTNNB1 and IP90 were chosen as two examples of abundant mRNAs in HEK293T cells, and RSL1D1 was studied because it contains a region highly homologous to the 20-nt region of *E. coli* tRNA$^{Ag}$ that is the native substrate of TadA(26). The TadA minimal substrate sequence is GCUCGGCUACGAACCGAG (SEQ ID NO: 1), while the homologous region of RSL1D1 mRNA is agUCGGCUACGGAAuuuAG (SEQ ID NO: 2), where upper-case letters indicate sequence identity. In all three transcripts, ABEmax generated low but detectable levels of RNA editing above the endogenous level of A-to-I editing from cellular deaminases(27, 29), which was measured using a Cas9(D10A)-only control. ABEmax expression increased both the extent of A-to-I conversions throughout the transcript (FIG. 1C), measured by the number of sequenced adenosines with an A-to-I conversion frequency >0.10%, as well as the magnitude of A-to-I editing (FIG. 1D), measured by the average percentage of A-to-I conversion at every sequenced adenosine. For example, ABEmax generated an average of 1.3±0.41% A-to-I conversion among all sequenced adenosines in RSL1D1 mRNA, a 22-fold increase relative to the Cas9(D10A) nickase-only control that averaged 0.060±0.010% A-to-I conversion in the same transcript. Likewise, ABEmax resulted in detectable deamination of 27±2 out of 46 adenosines sequenced in RSL1D1 mRNA, while the Cas9(D10A) nickase control resulted in detectable deamination of 7±1 (3.9-fold fewer) of these 46 adenosines (FIGS. 1C, 1D). To test if RNA editing activity requires fusion with the Cas9 component of the base editor, the TadA-TadA* monomer was overexpressed in trans with Cas9(D10A) nickase or dead Cas9 (dCas9) and observed substantial RNA editing under these conditions at all three tested transcripts (FIGS. 1C, 1D). This outcome confirmed that RNA editing activity arises from the unassisted binding of TadA domains to cellular RNA, and focused efforts to improve the DNA:RNA specificity of ABE on engineering these deaminases. Taken together, these results establish that the TadA-TadA* deaminase component of ABEmax mediates low levels of cellular RNA editing.

Glu 70 is a critical catalytic residue in *E. coli* TadA, and the TadA E70A mutant either alone(26) or in ABE(1) has no deaminase activity. In the soluble, N-terminally truncated version of TadA(26) used in ABE(1), Glu 70 corresponds to Glu 59, and will be referred to as Glu 59 hereafter. To identify which TadA monomers mediate RNA editing in ABEmax, inactivating E59A mutations were introduced into either the TadA or TadA* monomer of ABEmax and RNA (FIGS. 1C, 1D) and DNA (FIG. 1E) editing activity of the resulting variants was measured. Installing the E59A mutation in the wild-type TadA monomer to generate ABEmax (TadA E59A) modestly reduced the average number of edited adenosines in all three tested transcripts relative to ABEmax (FIG. 1C). Despite the modest reduction in RNA editing activity associated with ABEmax(TadA E59A), ABEmax(TadA E59A) maintains high DNA base editing activity similar to that of ABEmax. ABEmax averaged 46.6±3.9% DNA editing across the seven endogenous genomic sites tested, chosen because they result in a wide range of ABEmax editing efficiencies (from 85±6.6% to 4.5±0.70%), while ABEmax(TadA E59A) averaged 41.5±5.4% DNA editing at the same sites (FIG. 1E). ABEmax(TadA E59A) also displayed reduced indel formation at these seven genomic sites compared to ABEmax (FIGS. 4A-4D), from a mean of 2.3±0.39% with ABEmax to 1.1±0.24% with ABEmax(TadA E59A). These data suggest that inactivation of the catalytic domain in the wild-type TadA monomer can reduce off-target RNA editing and indel formation without substantially sacrificing on-target DNA editing efficiency.

Figure 1F:
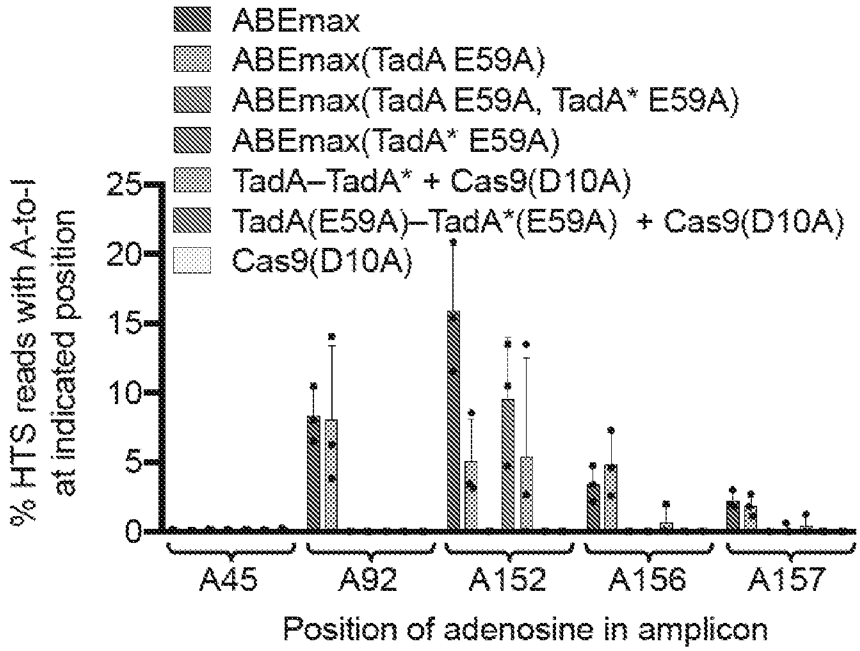

By contrast, neither ABEmax(TadA* E59A) nor ABEmax (TadA E59A, TadA* E59A) edit RNA (FIG. 1C, 1D) or DNA (FIG. 1E), with one notable exception: ABEmax (TadA* E59A), which contains a wild-type TadA monomer but an inactivated evolved TadA* monomer, edits RSL1D1 mRNA at position 152, the adenosine that is highly homologous to that of TadA's native tRNAArg substrate (FIG. 1F). Together, these data indicate that both wild-type TadA and TadA* in ABEmax can deaminate RNA in a Cas9-independent manner. This off-target RNA editing activity may be reduced by inactivating the wild-type TadA monomer, but residual RNA editing activity remains from TadA*, which cannot be inactivated without abolishing DNA editing activity (FIG. 1D).

Figure 1G:
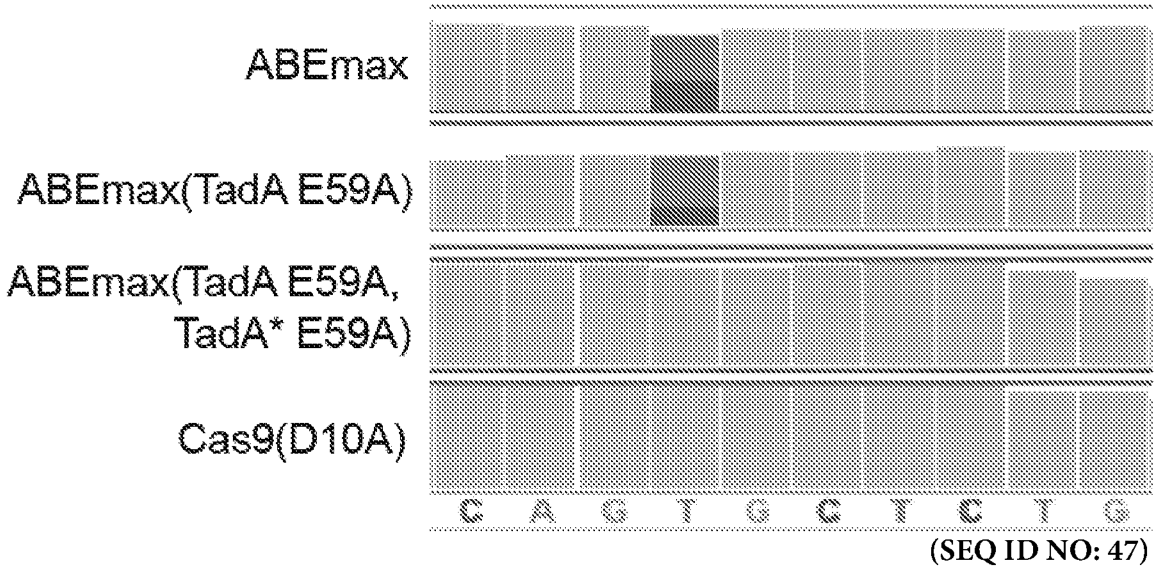

To test if these findings apply to many different cellular transcripts, transcriptome-wide analysis was performed of HEK293T cells treated with ABEmax, ABEmax(TadA E59A), ABEmax(TadA* E59A), and ABEmax(TadA E59A, TadA* E59A). Cells were transfected with plasmids expressing the base editor and an LDLR-targeting sgRNA. Targeting the base editors to an expressed gene mimics their typical use (3) and enables detection of the on-target U-to-C edit in the corresponding LDLR mRNA transcript during transcriptome-wide RNA-Seq as an internal positive control (FIG. 1G). Since A-to-I editing in cellular mRNA from endogenous ADAR deaminases is a common source of natural RNA editing in metazoans (27, 29), cells treated with Cas9(D10A) nickase were used only as a control to identify A-to-I RNA editing levels from endogenous cellular deaminases.

Figure 1H:
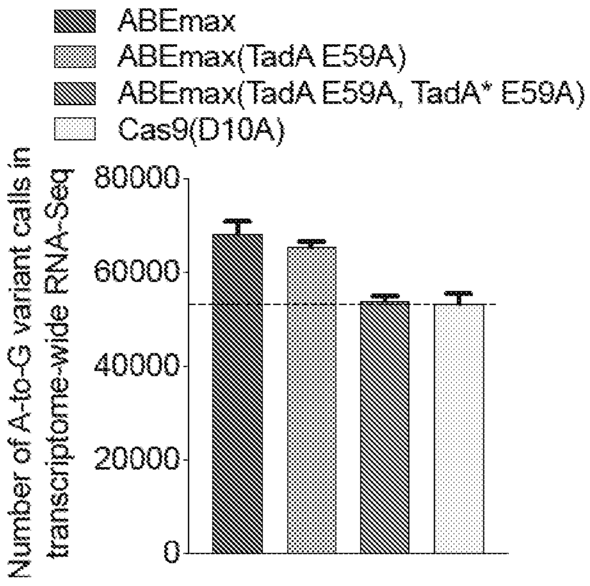

Transcriptome-wide RNA-seq data revealed that, on average, ABEmax overexpression induced 14,959 additional high-confidence A-to-I edits compared to the Cas9 nickase-only control (FIG. 1H). Although ABEmax overexpression adds only 28% more detected A-to-I edits than the 53,334 endogenous cellular A-to-I edits observed in the Cas9 nickase-only control, these additional ABEmax-induced RNA edits were widespread throughout the transcriptome, including 10,335 transcripts not edited in the Cas9 nickase-only control samples. These data confirm that low-level RNA editing is widespread throughout the transcriptome among cells overexpressing ABEmax.

Figure 1I:
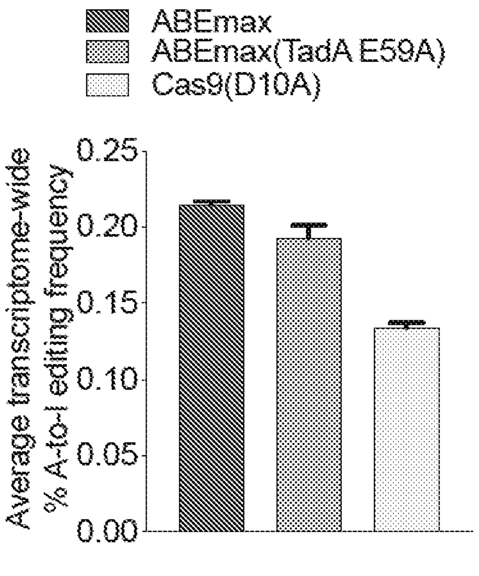

RNA editing across the transcriptome was reduced by inactivating either TadA or TadA* monomers. Catalytically inactivated ABEmax(TadA E59A, TadA* E59A) resulted in 53,917 A-to-I edits, similar to the 53,334 A-to-I edits detected in the Cas9 nickase-only control. ABEmax(TadA E59A) resulted in 12,142 more A-to-I edits than the Cas9 nickase-only control, 19% fewer additional A-to-I edits than the 14,959 mediated by ABEmax (FIG. 1H). The average A-to-I RNA editing frequency across all transcripts was 0.22% for ABEmax, 0.19% for ABEmax(TadA E59A), and 0.13% for Cas9(D10A) nickase only (FIG. 1I). Together, these findings indicate that transcriptome-wide RNA editing is modestly reduced by inactivating the wild-type TadA monomer in ABEmax.

Given the lack of an elucidated structure of ABE or of the *E. coli* TadA homodimer bound to RNA, the crystal structure of *S. aureus* TadA was used, which has high sequence homology to *E. coli* TadA (25), to guide the design of ABE mutants that further reduce RNA editing. Starting with ABEmax(TadA E59A), the construct with the inactivated wild-type TadA domain that shows reduced RNA editing but maintains strong DNA base editing (FIGS. 1C-1H), mutations were installed into the evolved TadA* monomer.

Example 2

Three TadA* residues were identified, predicted to interact with the RNA substrate as targets for substitutions that might impair TadA*-mediated RNA deamination. It was hypothesized that impeding the ability of TadA* to accommodate 2'-hydroxyl groups that are present in RNA, but absent in DNA, by replacing these three amino acids with larger or more hydrophobic residues (Gln, Phe, Trp, or Met) could further improve the DNA versus RNA editing specificity of ABEmax(TadA E59A). Arg 47 is predicted to form a hydrogen bond with the 2'-hydroxyl group of the substrate adenosine (FIG. 2A). Arg 47 was replaced in TadA* with Gln, Phe, Trp, or Met in an effort to abrogate this interaction. A series of ABEmax mutants was also generated with TadA* substitutions at either Asn 108 (FIG. 2B) or Val 106 (FIG. 2C), two residues that are located close to the catalytic site of TadA, and that mutated from Asp 108 and Ala 106 during the evolution of TadA*(1). Asp 108 is predicted to directly hydrogen bond with the 2'-hydroxyl group of the uridine immediately 5' of the substrate adenosine (FIG. 2B), and replacement of Ala 106 might fill some of the space that accommodates this uridine, including its 2' hydroxyl group, with larger and more hydrophobic side chains (FIG. 2C). Asn 108 was replaced in ABEmax TadA* with Gln, Phe, Trp, Lys, or Met, and Val 106 in ABEmax TadA* with Gln, Phe, Trp, or Met, in an effort to disrupt the ability of TadA* to accommodate ribonucleotides by eliminating the possibility of forming hydrogen bonds with 2' hydroxyl groups in RNA or by steric occlusion. An additional Asn 108 Lys mutation was also tested to provide a polar side-chain that is incapable of serving as a hydrogen bond acceptor assuming protonation at physiological pH.

HEK293T cells were transfected with each of these 13 ABEmax(TadA E59A) mutants and measured the resulting on-target DNA A•T-to-G•C base editing at the seven genomic loci tested (FIG. 2D). High-throughput sequencing of regions of IP90, RSL1D1, and CTNNB1 cDNAs was used to rapidly assess the RNA editing activities of these 13 mutants in HEK293T cells (FIGS. 2E, 2F) prior to transcriptome-wide RNA-seq analyses.

Replacing TadA* Arg 47 in ABEmax(TadA E59A) with Gln, Met, Phe or Trp maintained relatively high DNA base editing efficiency, particularly at sites where the target A is at protospacer position 5 (counting the PAM as positions 21-23). Average editing efficiencies were reduced from a mean of 47±3.9% for ABEmax(TadA E59A) to a range of 31-41% for the four TadA* Arg 47 variants. Among the four Arg 47 mutants tested, ABEmax(TadA E59A, TadA* R47M) and ABEmax(TadA E59A, TadA* R47Q), the most efficient variants for DNA base editing, showed little or no reduction in RNA editing activity compared to ABEmax(TadA E59A) (FIGS. 2E, 2F). The two variants in which Arg 47 was replaced with larger and more rigid hydrophobic residues, ABEmax(TadA E59A, TadA* R47F) and ABEmax(TadA E59A, TadA* R47W), resulted in up to a 2.0-fold reduction in the number of edited adenosines in the interrogated transcripts (FIG. 2E). Unfortunately, this reduction in RNA editing was accompanied by a similar reduction in DNA editing at sgRNAs in which the target A was located at positions other than position 5 in the protospacer (FIG. 2D). These data indicate that replacing Arg 47 with Phe or Trp impairs both RNA and DNA editing and replacing this residue with Met or Gln impairs neither DNA nor RNA editing.

Mutation of TadA* Asn 108 in ABEmax(TadA E59A) generally preserved DNA base editing at sites in which the target A was at protospacer position 5, but greatly reduced DNA editing at other target sites. The most active Asn 108 mutant, ABEmax(TadA E59A, TadA* N108K), mediated 25±0.2% average on-target DNA editing (FIG. 2D), a 1.9-fold reduction compared to ABEmax, but also exhibited the highest levels of RNA editing among the Asn 108 mutants assayed (FIG. 2E and FIG. 2F). Mutation of TadA* Asn 108 in ABEmax(TadA E59A) to Phe, Trp, Gln or Met greatly reduced RNA editing compared to ABEmax in the three transcripts sequenced at depth to levels statistically indistinguishable from background RNA editing observed in the Cas9(D10A)-only controls (Student's two-tailed T test, p>0.05 for comparisons between number of edited adenosines in each transcript) (FIG. 2E).

Together, these data indicate that Asn 108 in TadA* is important for efficient DNA base editing at protospacer positions beyond the most preferred one (position 5), and is also essential for RNA editing. The ABEmax(TadA E59A, TadA* N108Q) or ABEmax(TadA E59A, TadA* N108W) variants may be useful when the target A is at protospacer position 5, and minimizing RNA editing is critical.

Substitution of TadA* Val 106 in ABEmax(TadA E59A) resulted in variants that exhibited much lower RNA editing while maintaining DNA editing levels similar to those of ABEmax(TadA E59A) and ABEmax. All four Val 106 mutants mediated effective DNA base editing across the seven genomic loci tested; the most efficient DNA base editor among these mutants was ABEmax(TadA E59A, TadA* V106W), hereafter referred to as ABEmaxAW, which yielded an average of 36±1.4% A•T-to-G•C DNA editing (compared to 41±5.4% for ABEmax(TadA E59A), and 47±3.9% for ABEmax). ABEmaxAW exhibited both the highest level of DNA base editing and the lowest level of RNA off-target editing amongst the Val 106 mutants tested (FIGS. 2E, 2F). Analysis of the RNA isolated from cells transfected with ABEmaxAW indicated that the number of detectable A-to-I edits among the regions of the three transcripts analyzed was significantly reduced from an average of 94±8 (out of 182 total adenosines) with ABEmax to 26±10 with ABEmaxAW, similar to the background of 12±6 for Cas9 nickase alone (FIG. 2E). The average magnitude of A-to-I edits was also greatly reduced in cells treated with ABEmaxAW (0.068% average A-to-I editing frequency among 182 total adenosines) to levels approaching those observed from Cas9 nickase alone (0.041% average), a 7.2-fold reduction compared with the 0.49% average A-to-I editing frequency of ABEmax (FIG. 2F). These findings establish that ABEmaxAW greatly reduces off-target RNA editing while preserving most of the on-target DNA editing activity of ABEmax.

Example 3

Figure 5A:
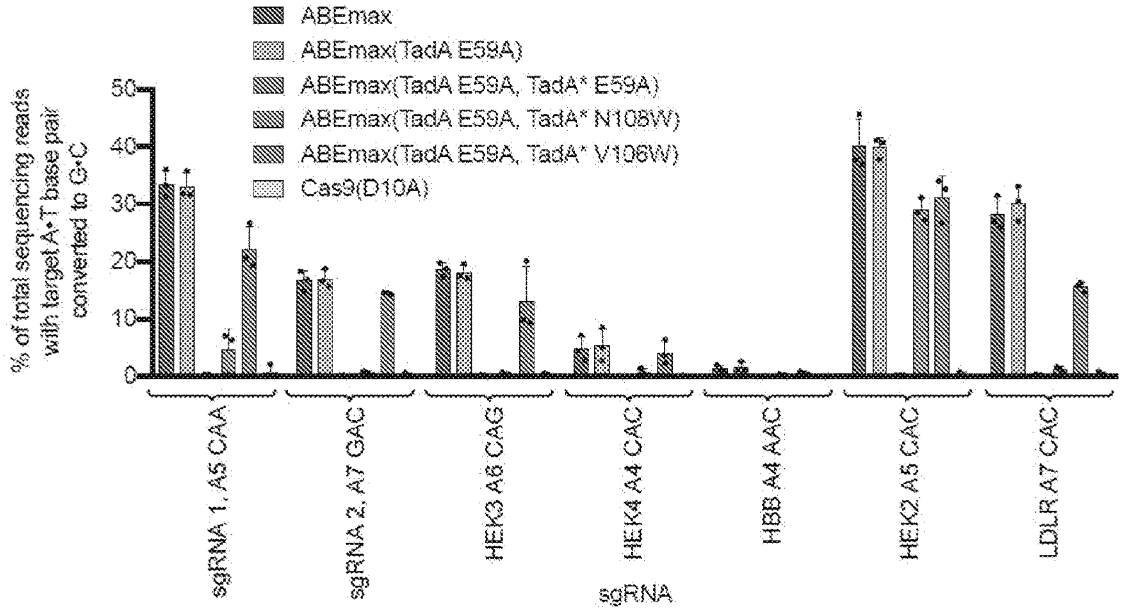
FIGS. 5A to 5B illustrate DNA base editing and indel formation in HeLa cells from ABEmax and ABEmax mutants. To measure DNA base editing (FIG. 5A) and indel formation (FIG. 5B), HeLa cells were lipofected with the indicated base editor plasmid combined with the indicated sgRNA plasmid. After 48 hours, genomic DNA was harvested, amplified by PCR, and subjected to HTS. Data are shown as individual data points and mean±s.d. for n=3 independent biological replicates performed at different times.
Figure 5B:
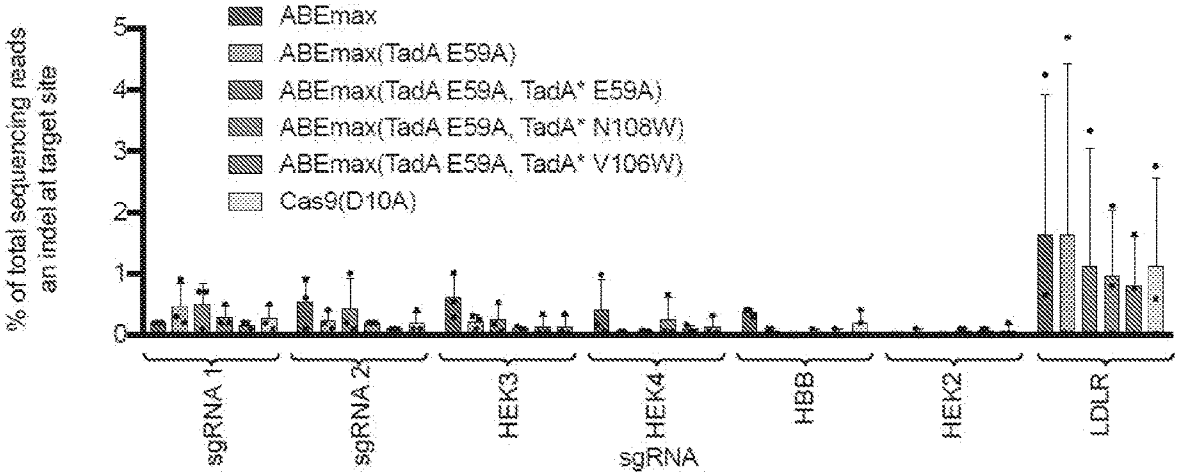
Figure 6A:
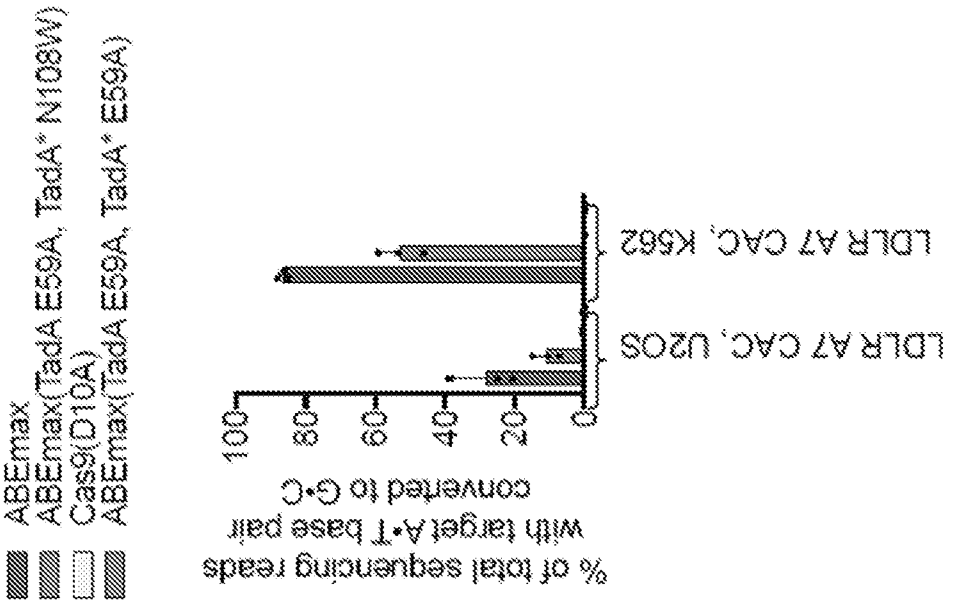
FIGS. 6A to 6F illustrate DNA base editing, indel formation, and RNA editing in U2OS and K562 cells harvested 48 hours after nucleofection with ABEmax, ABEmax mutants, or Cas9(D10A). DNA base editing efficiencies (FIG. 6A) and indel frequencies (FIG. 6B) were measured in indicated cells 48 hours days after nucleofection by HTS. RNA from nucleofected U2OS or K562 cells was harvested simultaneously with genomic DNA, and reverse transcription and HTS were used to assess the frequency of sequenced adenosines in three mRNA transcripts with measurable A-to-I conversion in U2OS cells (FIG. 6C), the average frequency of A-to-I conversion in three mRNA transcripts in U2OS cells (FIG. 6D), the frequency of sequenced adenosines in three mRNA transcripts with measurable A-to-I conversion in K562 cells (FIG. 6E), and the average frequency of A-to-I conversion in three mRNA transcripts in K562 cells (FIG. 6F). Data are shown as individual data points and mean±s.d. for n=3 independent biological replicates.
Figure 6B:
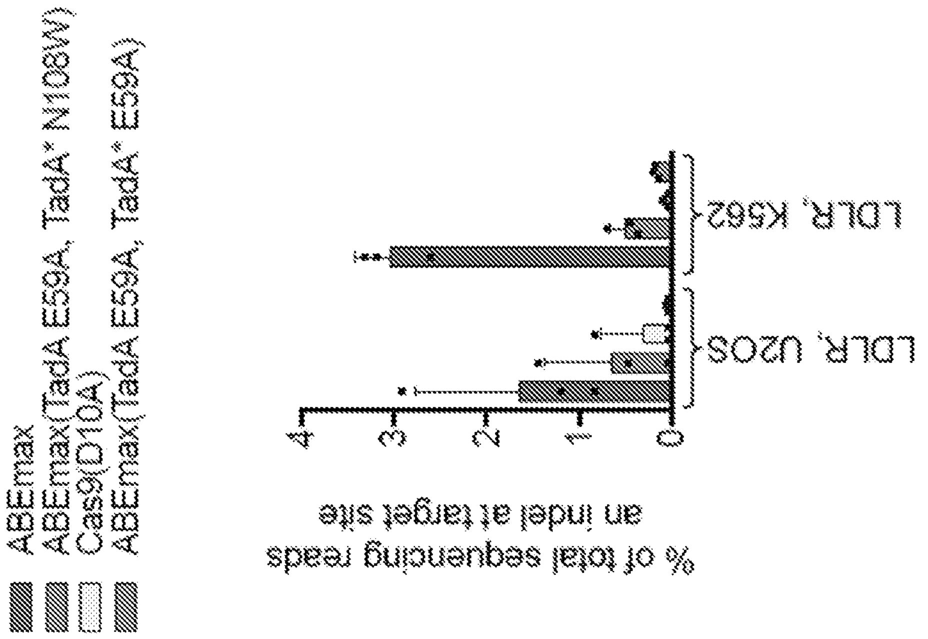
Figure 6C:
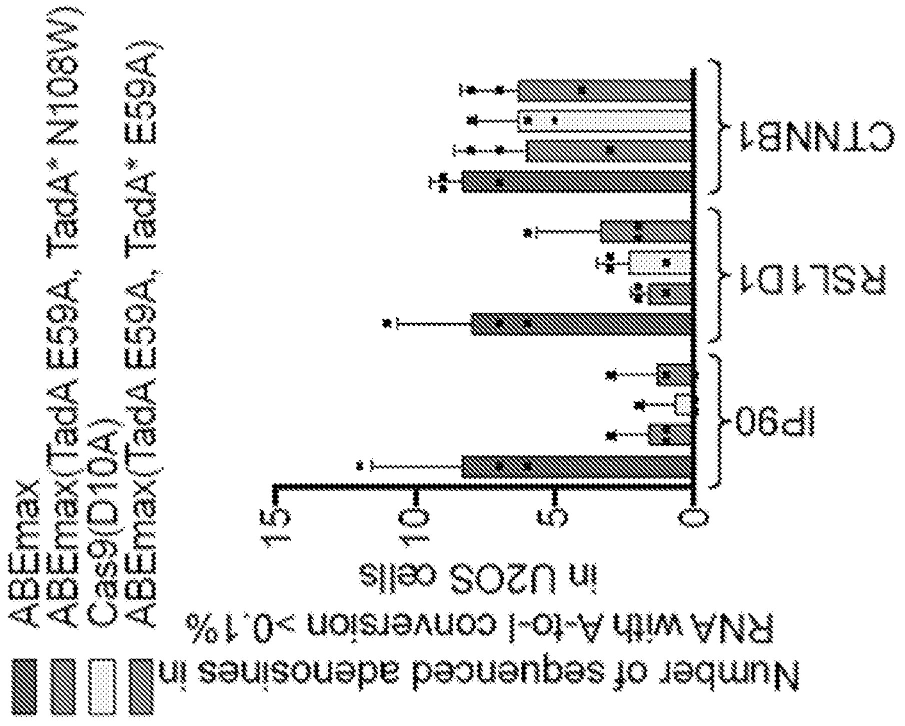
Figure 6D:
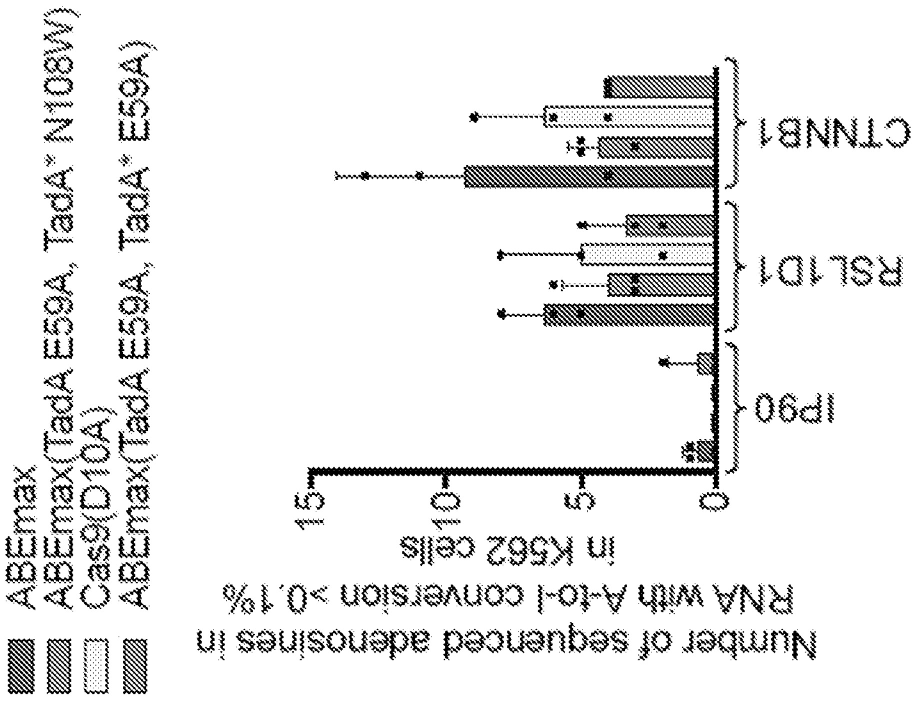
Figure 6F:
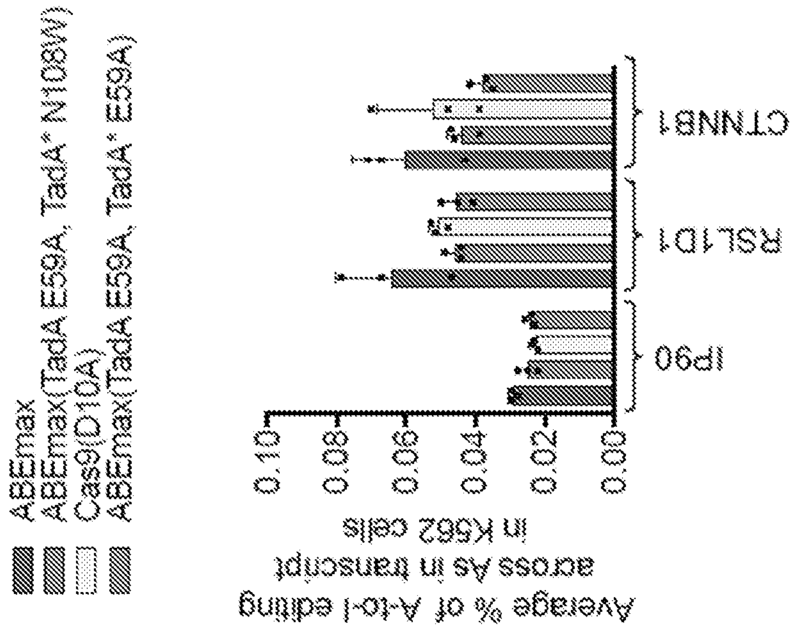
Figure 6E:
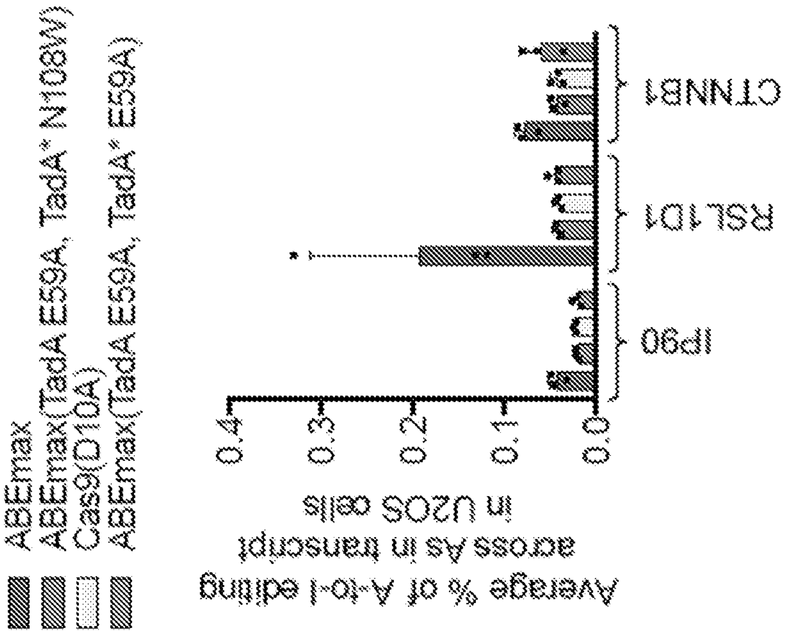

The applicability of the findings was tested to other mammalian cell types. First, the DNA base editing activities of ABEmax, ABEmax(TadA E59A), ABEmaxAW, and ABEmax(TadA E59A, TadA* N108W) in HeLa cells (FIGS. 5A-5B), and ABEmax and ABEmaxAW in U2OS and K562 cells (FIGS. 6A-6F) were compared. DNA base editing efficiencies among unsorted HeLa and U2OS cells were uniformly lower than in HEK293T cells (FIG. 5A), possibly due to poorer transfection or nucleofection efficiencies(15). The DNA base editing activity of ABEmaxAW relative to ABEmax and ABEmax(TadA E59A), however, generally remained similar in all three cell types (FIGS. 5A, 6A). Next, RNA editing frequencies and magnitudes were investigated in U2OS and K562 cells, and it was found that compared to ABEmax, the use of ABEmaxAW greatly reduced RNA editing to levels indistinguishable from those of the Cas9(D10A) control (FIGS. 6C and 6D). Together, these data indicate that ABEmaxAW can mitigate RNA editing in multiple mammalian cell types.

Figure 7A:
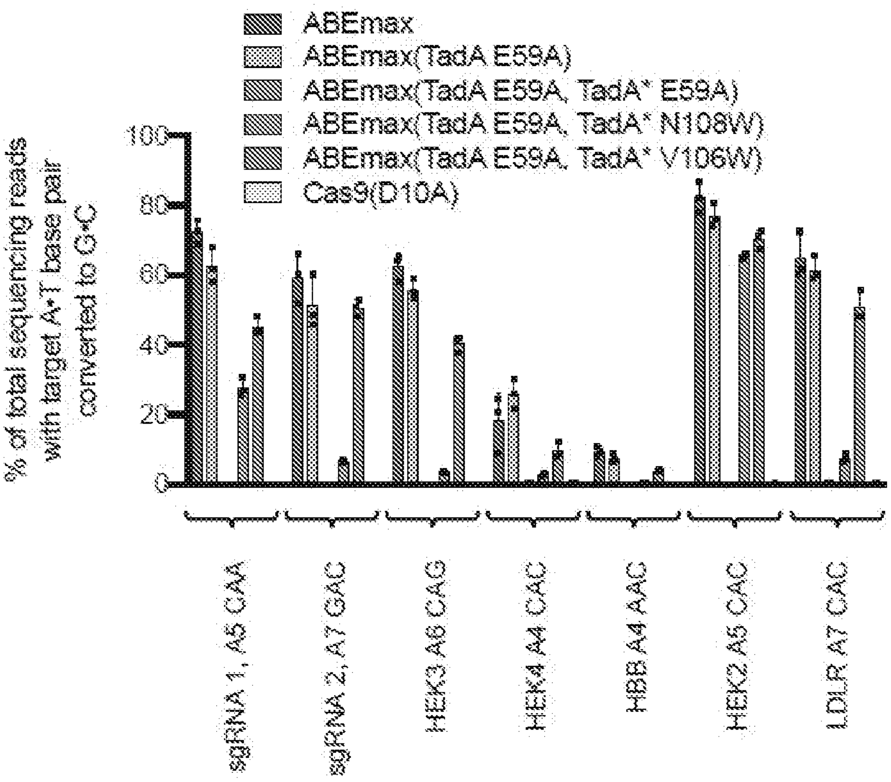
FIGS. 7A to 7D illustrate DNA base editing, indel formation, and RNA editing in HEK293T cells harvested 5 days after transfection with ABEmax or ABEmax mutants. DNA base editing efficiencies (FIG. 7A) and indel frequencies (FIG. 7B) were measured in HEK293T cells 5 days after transfection. RNA from transfected HEK293T cells was harvested simultaneously with genomic DNA, and reverse transcription and HTS was used to assess the frequency of sequenced adenosines with measurable A-to-I conversion (FIG. 7C) and the average frequency of A-to-I conversion in three mRNA transcripts (FIG. 7D). Data are shown as individual data points and mean±s.d. for n=3 independent biological replicates performed at different times.
Figure 7B:
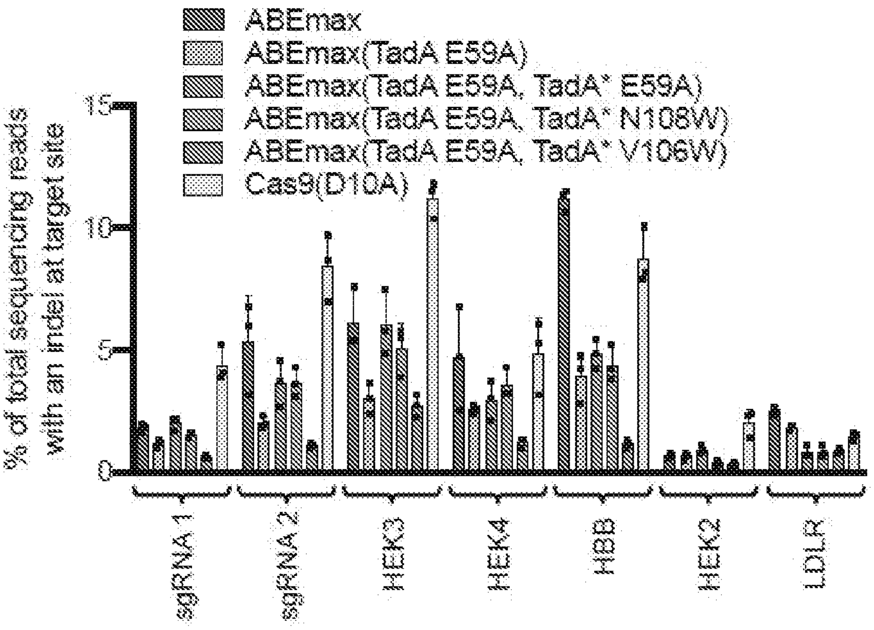
Figure 7C:
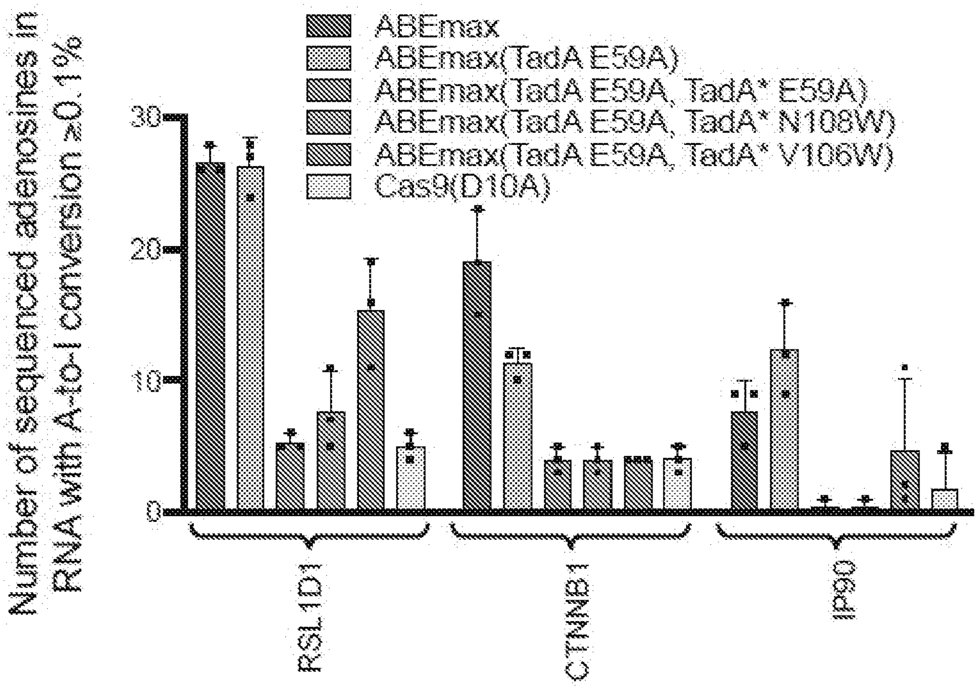
Figure 7D:
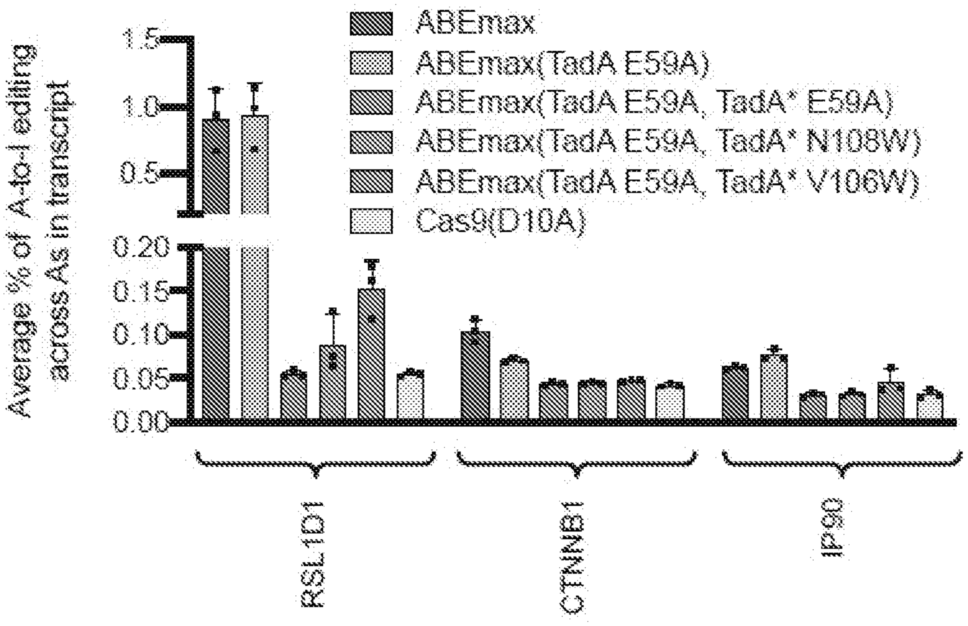

The effect of longer exposure time to ABEmax or ABEmaxAW in HEK293T cells was assessed by harvesting cells 5 days post-transfection, instead of 48 hours. This change increased the average DNA base editing associated with both ABEmax and ABEmaxAW by 1.1-fold, to 52±2.7% for ABEmax and 39±1.7% with ABEmaxAW (FIGS. 7A, 7B). Surprisingly, average RNA editing was reduced compared to the 48-hour treatment; ABEmax yielded 0.29±0.063% A-to-I average editing across the 182 adenosines sequenced (compared with 0.49±0.13% at 48 hours). The average frequency of A-to-I mutation with ABEmaxAW after 5 days (0.074±0.014%, 3.9-fold lower than that of ABEmax) remained close to the background frequency associated with Cas9(D10A) nickase alone of 0.051±0.010% (FIGS. 7C, 7D). It is believed that the steady loss (or silencing) of transfected plasmids expressing base editors, coupled with the constant degradation and replenishment of the transcriptome, may result in lower RNA editing rates at longer time points.

Figure 8:
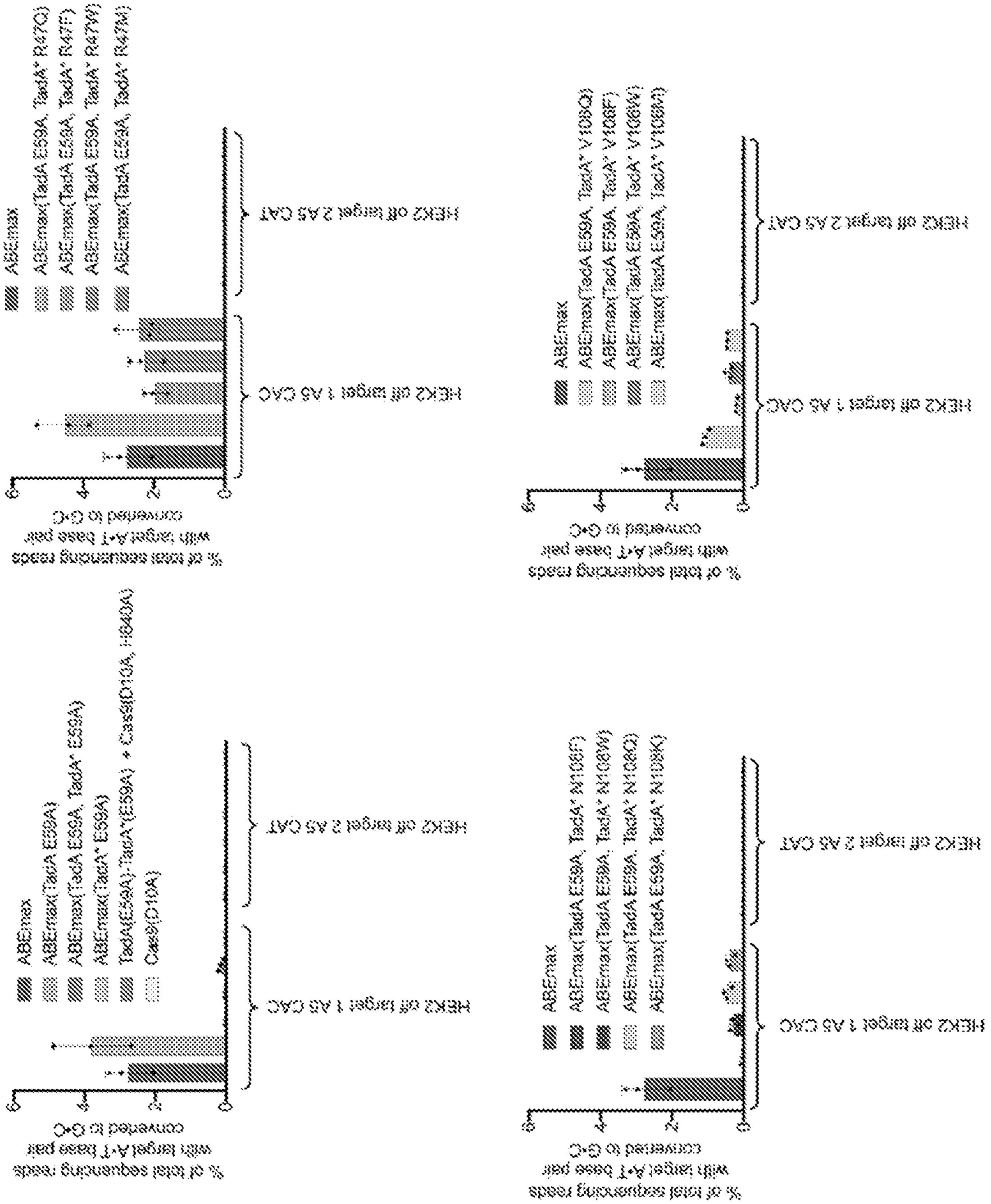
FIG. 8 shows off-target DNA base editing associated with the HEK site 2 locus by ABEmax and ABEmax mutants. Off-target genomic DNA loci for the HEK site 2 sgRNA previously identified by GUIDE-Seq (31) were analyzed by HTS following treatment with the indicated ABE7.10 variants. Data are shown as individual data points and mean±s.d. for n=3 independent biological replicates, performed on different days.
Figure 9:
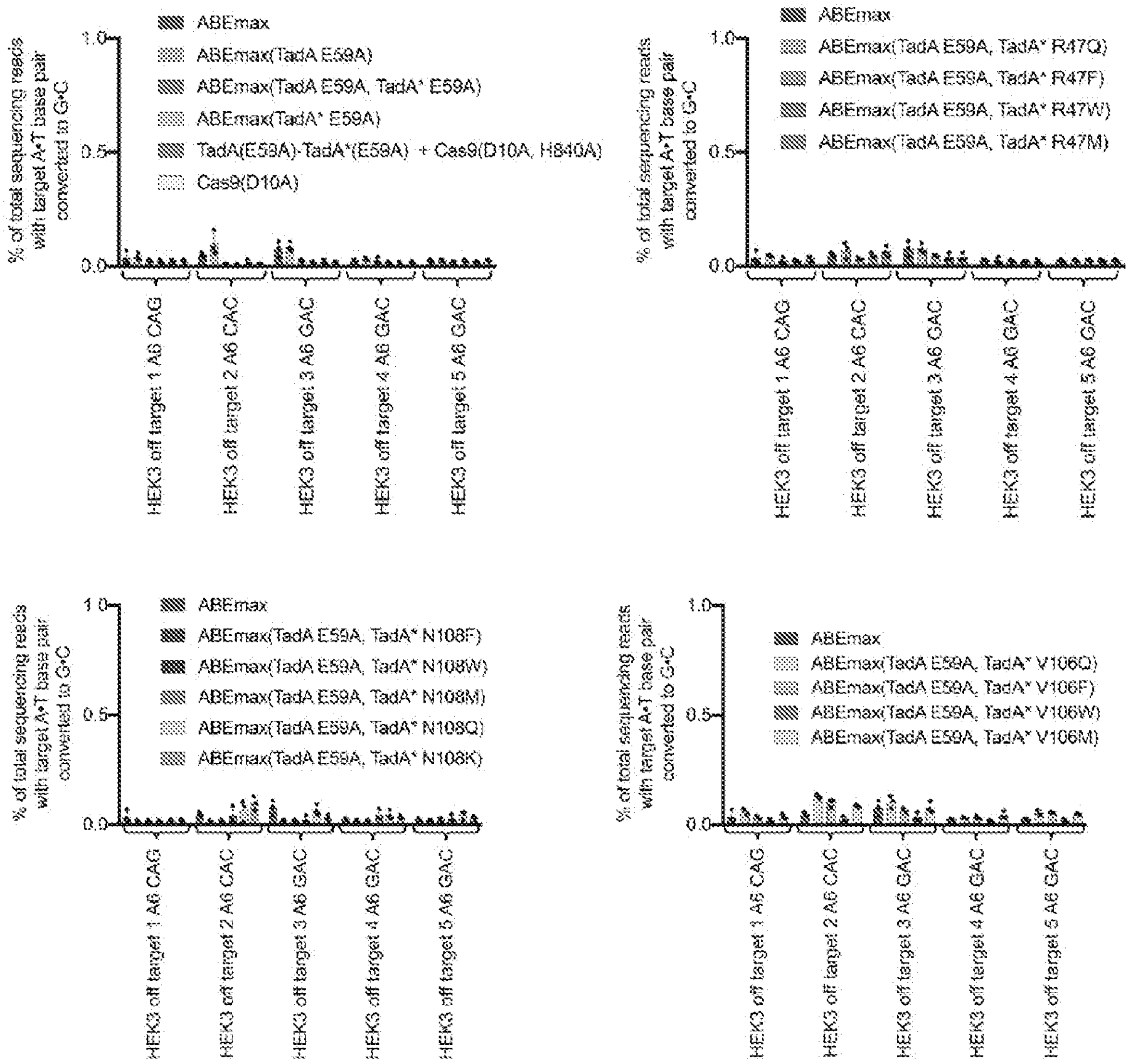
FIG. 9 shows off-target DNA base editing associated with the HEK site 3 locus by ABEmax and ABEmax mutants. Off-target genomic DNA loci for the HEK site 3 sgRNA previously identified by GUIDE-Seq (31) were analyzed by HTS following treatment with the indicated ABE7.10 variants. Data are shown as individual data points and mean±s.d. for n=3 independent biological replicates, performed on different days.
Figure 10:
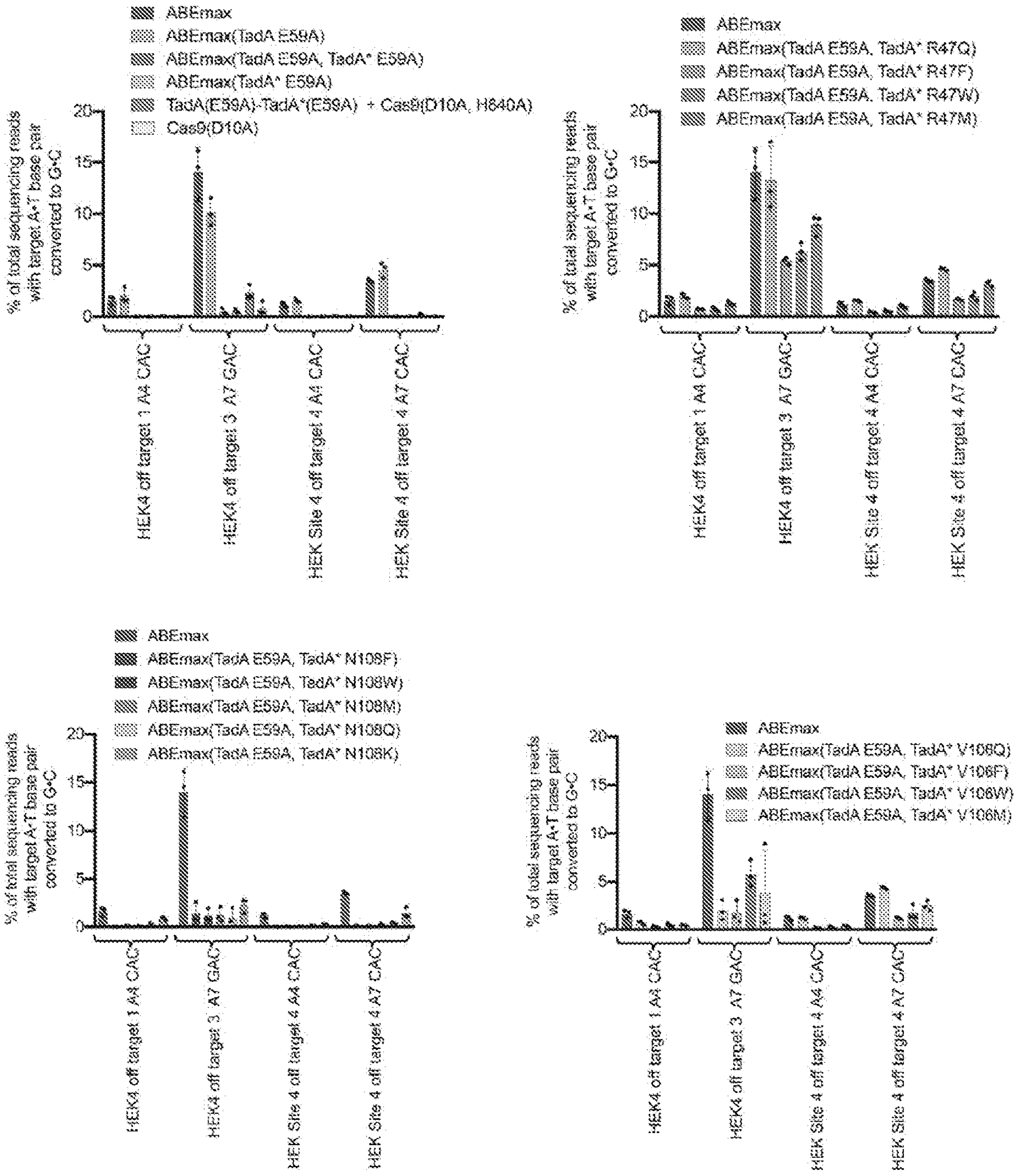
FIG. 10 shows off-target DNA base editing associated with the HEK site 4 locus by ABEmax and ABE7.10 mutants. Off-target genomic DNA loci for the HEK site 4 sgRNA previously identified by GUIDE-Seq (31) were analyzed by HTS following treatment with the indicated ABE7.10 variants. Data are shown as individual data points and mean±s.d. for n=3 independent biological replicates, performed on different days.

These TadA* mutations might further weaken the ability of ABEmax variants to bind off-target DNA sequences that are already more weakly bound by Cas9. To test this possibility, the levels of off-target DNA editing were measured by ABEmax and a subset of the ABEmax variants described above. HTS was used to assess the frequencies of off-target A•T-to-G•C base editing and indel formation at 12 known off-target sites associated with HEK site 2, HEK site 3 and HEK site 4(31) (FIGS. 8, 9, 10). Among these 12 off-target sites, ten had at least one adenosine within the canonical ABE editing window (from protospacer position 4 to 8)(1, 3). The mean A•T-to-G•C editing efficiency at these ten candidate off-target loci from ABEmax was 2.1±0.22%, similar to that of ABEmax(TadA E59A) (2.0±0.28%) (FIGS. 8, 9, 10). Notably, ABEmaxAW generated an average off-target editing frequency of 0.79±0.18%, a 2.5-fold improvement compared to ABEmax(TadA E59A), and a 2.7-fold improvement relative to ABEmax. Collectively, these results indicate that mutations that reduce the tolerance of ABEmax for RNA editing also increase the DNA specificity of base editing, likely by reducing DNA binding interactions that support productive editing of off-target loci.

Notably, ABEmaxAW also generated 3.7-fold fewer indels than ABEmax at the seven on-target DNA loci tested (from an average of 2.3±0.39% with ABEmax to 0.62±0.0069% with ABEmaxAW (FIGS. 4A-4D). The reason for this reduced indel frequency is unclear, but it is hypothesized that indel formation may be dependent on the structure or activity of the wild-type TadA monomer. Consistent with this hypothesis, ABEmax(TadA E59A) also shows reduced average indel formation (1.1±0.24%) and ABEmax(TadA* E59A), which cannot perform DNA base editing, induces indels at an elevated frequency of 4.3±0.45% (FIGS. 4A-4D).

Example 4

Figure 11A:
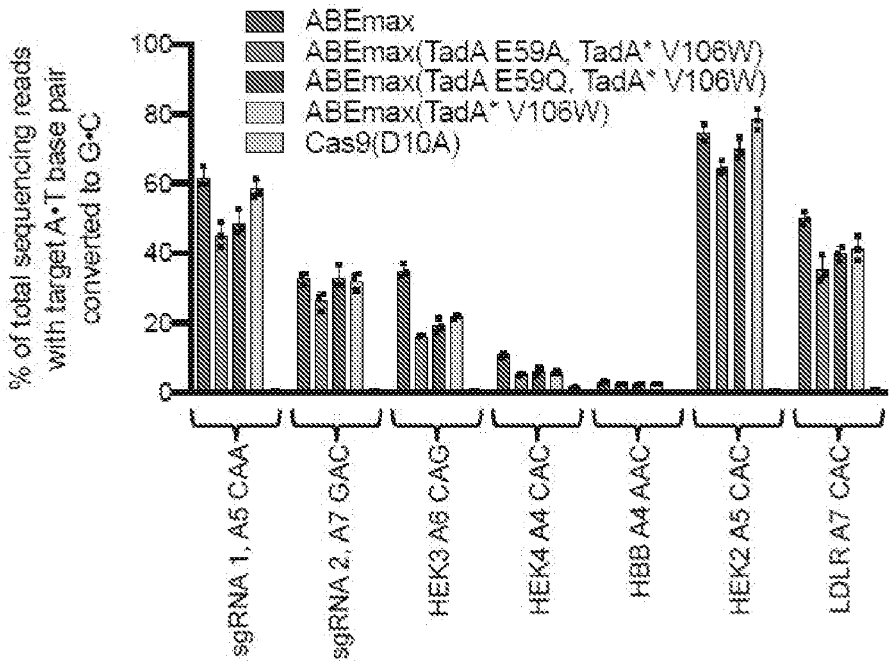
FIGS. 11A to 11D demonstrate results of DNA base editing, indel formation, and RNA editing in HEK293T cells harvested 48 hours after transfection with ABEmax, ABEmaxAW, ABEmaxQW, or ABEmax(TadA* A106V). DNA base editing efficiencies (FIG. 11A) and indel frequencies (FIG. 11B) were measured in HEK293T cells harvested 48 hours after transfection. RNA from transfected HEK293T cells was harvested simultaneously with genomic DNA, and reverse transcription and HTS was used to assess the frequency of sequenced adenosines with measurable A-to-I conversion (FIG. 11C) and the average frequency of A-to-I conversion in three mRNA transcripts (FIG. 11D). Data are shown as individual data points and mean±s.d. for n=3 independent biological replicates performed at different times.
Figure 11B:
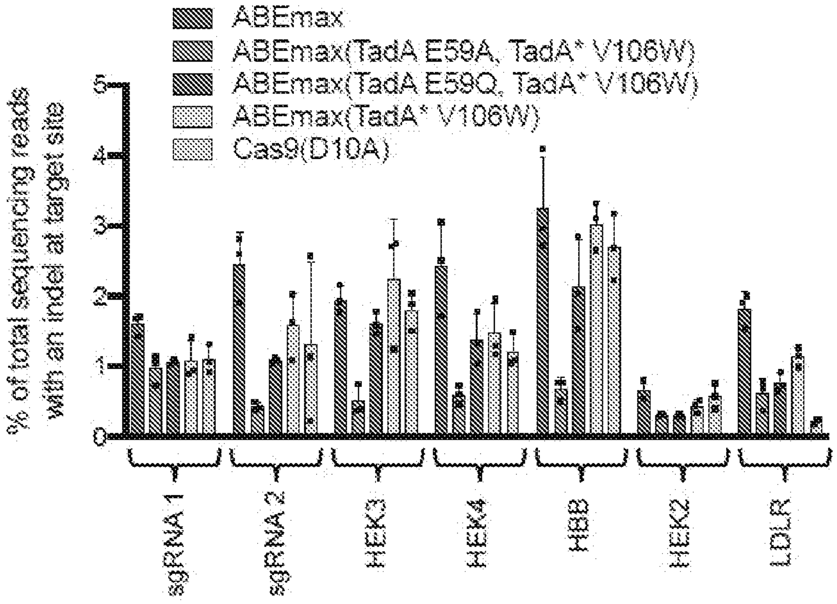
Figure 11C:
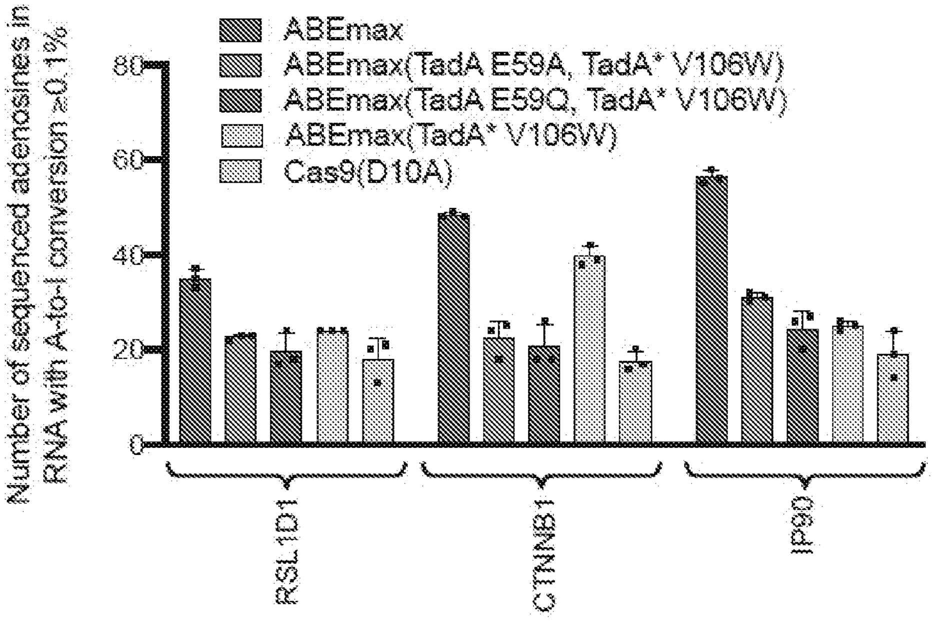
Figure 11D:
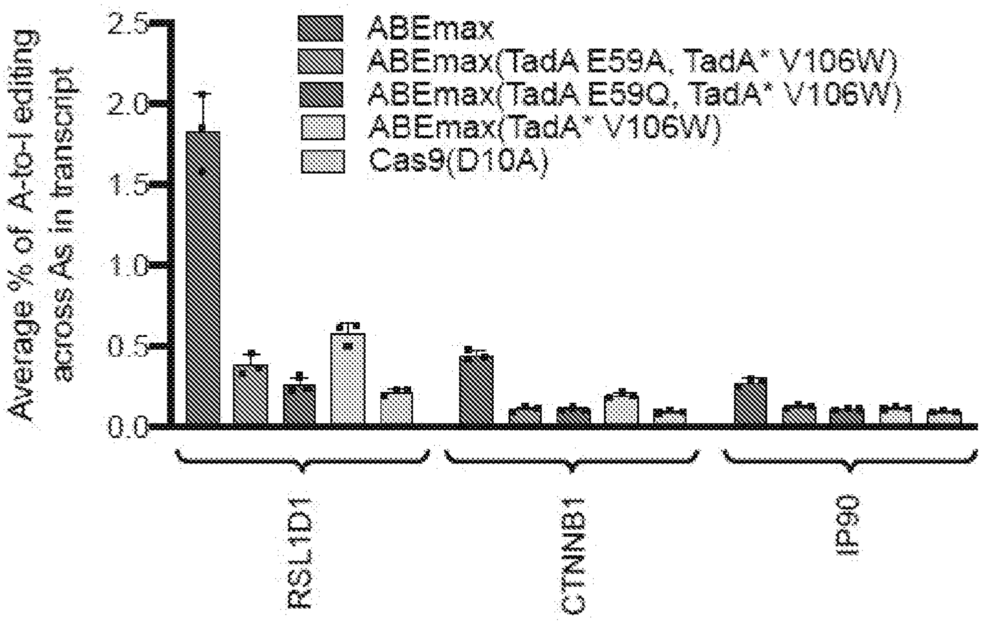

To further illuminate the impact of V106W in TadA* on the DNA and RNA editing activities of ABE, two additional ABEmax mutants, ABEmax(TadA E59, TadA* V106W) (ABEmaxEW), and ABEmax(TadA E59Q, TadA* V106W) (ABEmaxQW), were generated and tested (FIGS. 11A-11D). ABEmaxEW displayed slightly higher DNA on-target editing frequencies than ABEmaxAW (FIG. 11A), but also greater indel (FIG. 11B) and RNA editing frequencies (FIGS. 11C, 11D), confirming that mutation of both the wild-type and the evolved TadA monomers is required for the most effective reduction in RNA editing and indel frequencies. ABEmaxQW performed as well as or slightly better than ABEmaxAW at on-target DNA base editing (FIG. 11A) and displayed similarly low levels of off-target RNA editing (FIGS. 11C, 11D). Consistent with observations that the wild-type TadA monomer plays a role in indel formation, both ABEmaxEW and ABEmaxQW displayed substantially higher indel frequencies than ABEmaxAW (FIG. 11B). These comparisons together indicate that both inactivation of the wild-type TadA and mutation of the evolved monomer with V106W, are required to minimize off-target RNA editing, and ABEmaxQW may display higher on-target base editing efficiency at some sites than ABEmaxAW, but without the consistently lower indel frequencies of ABEmaxAW.

Example 5

Figure 2I:
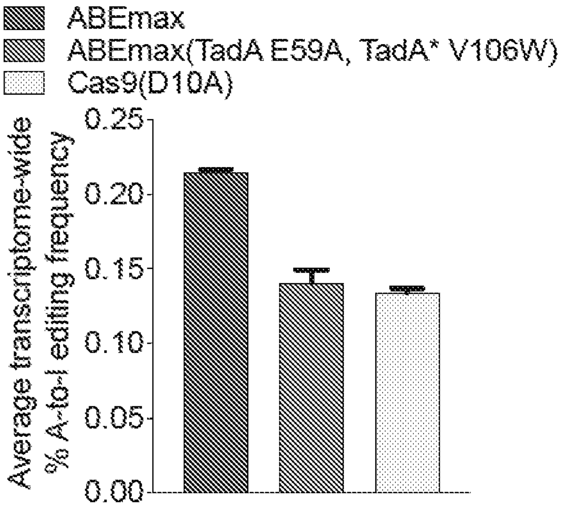

Finally, RNA-Seq was performed to identify transcriptome-wide A-to-I editing frequencies associated with ABEmaxAW. Importantly, robust on-target DNA editing activity was confirmed in the RNA-seq samples treated with ABEmax, ABEmax(E59A), and ABEmaxAW by observing substantial U-to-C mutation in the LDLR mRNA, which resulted from base editing the corresponding genomic DNA site directed by the LDLR-targeting sgRNA (FIG. 2G). While the proportion of edited LDLR mRNA reads is reduced in the ABEmaxAW sample (24/90, 27%) as compared to the ABEmax (37/98, 38%) and ABEmax(TadA E59A) (18/66, 27%), the numbers of LDLR mRNA transcripts aligned to the reference sequence are low, making precise quantitation challenging. Consistent with the above results analyzing the three test transcripts in depth, ABEmaxAW only slightly elevated the number of A-to-I edits (57,685) beyond those observed in the Cas9(D10A) nickase-only control (53,334). ABEmaxAW thus resulted in substantially fewer transcriptome edits compared to ABEmax or ABEmax(E59A) (10,608 fewer A-to-I edits than ABEmax, and 7,791 fewer than ABEmax(E59A)) (FIGS. 2G, 2H). The average A-to-I RNA editing frequency was also compared across all transcripts, and it was found that the 0.22% average A-to-I RNA editing for ABEmax was reduced to 0.14% for ABEmaxAW and to 0.13% for the Cas9(D10A) nickase-only control (FIG. 2I). These findings confirm that ABEmaxAW maintains strong DNA base editing activity while exhibiting much lower transcriptome-wide RNA editing compared to ABEmax.

Figure 3A:
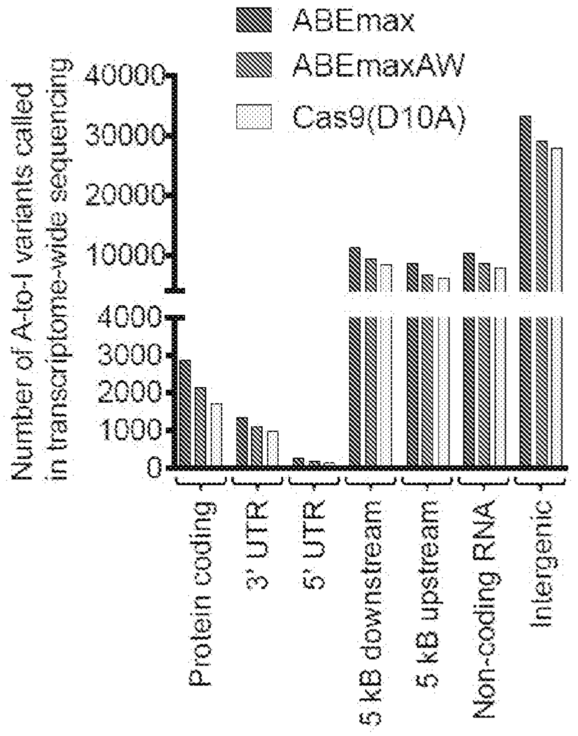
FIGS. 3A to 3C show analysis of A-to-I RNA edits found in transcriptome-wide RNA sequencing.
Figure 3B:
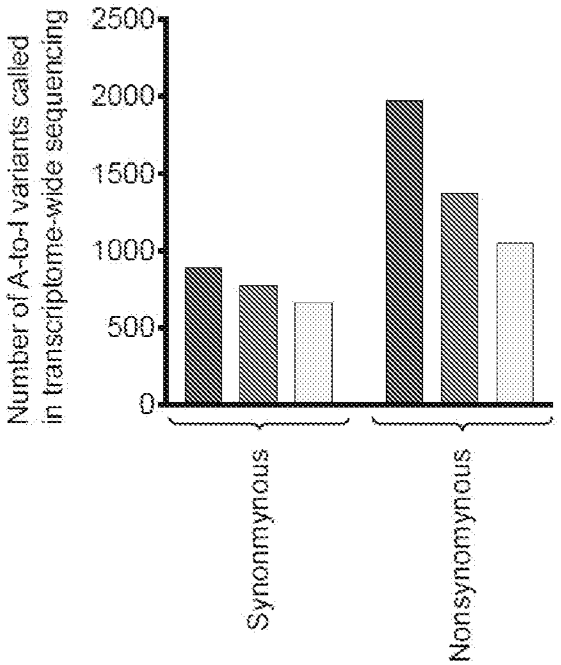
Figure 3C:
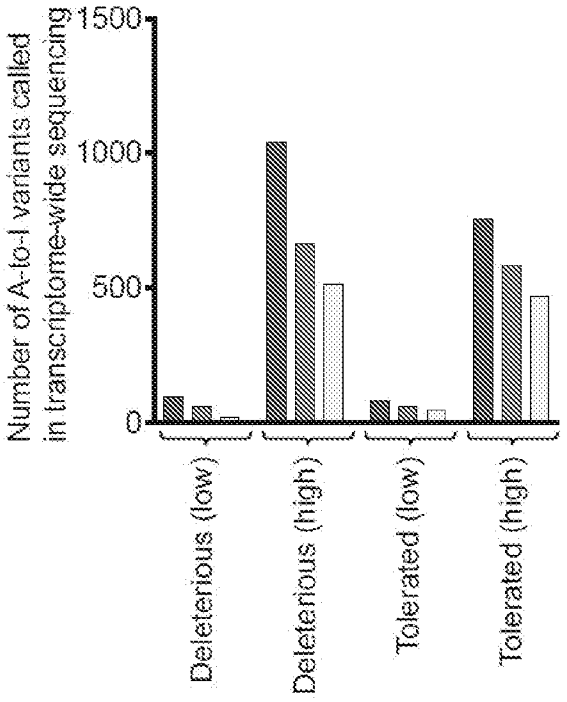
Figure 4A:
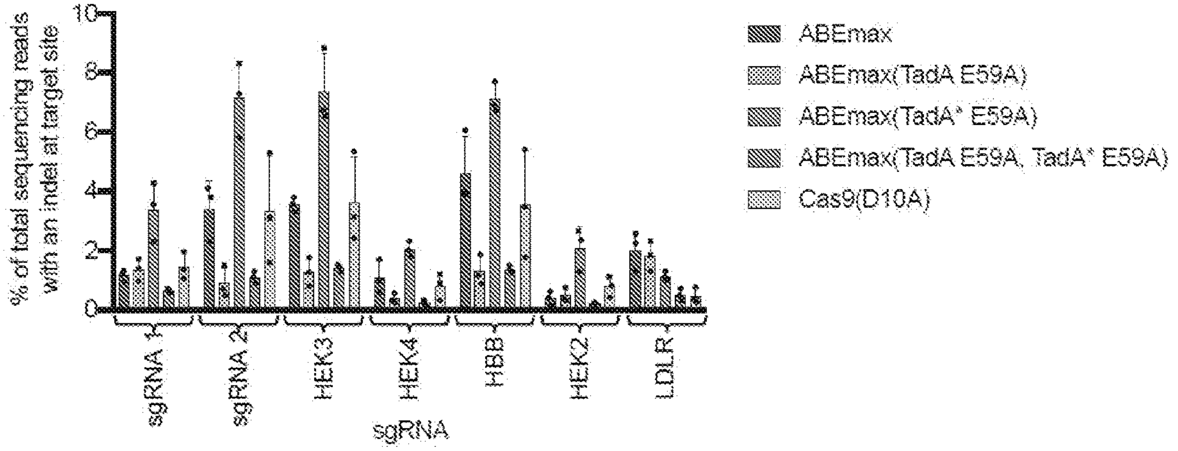
FIGS. 4A to 4D show indel frequencies associated with ABEmax and engineered ABEmax mutants.
Figure 4B:
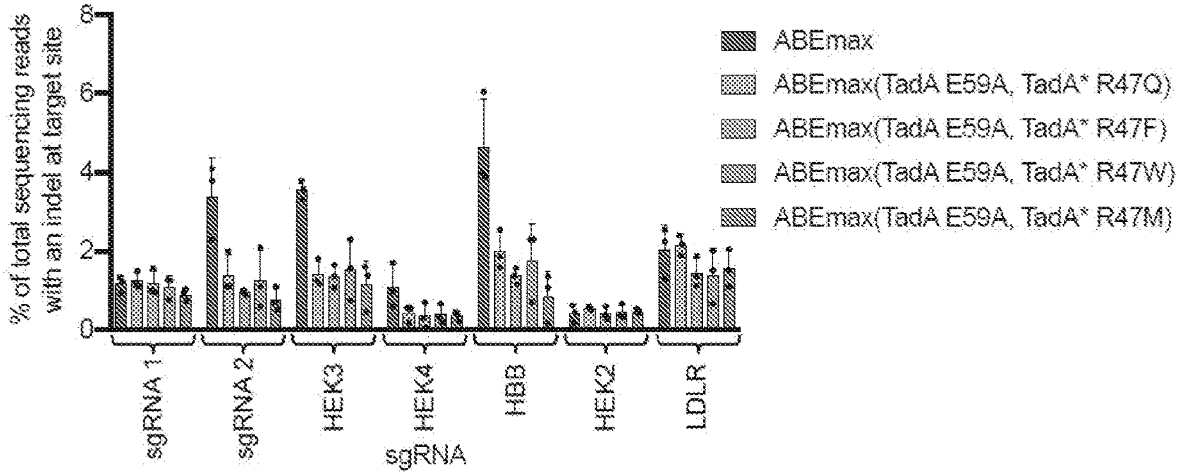
Figure 4C:
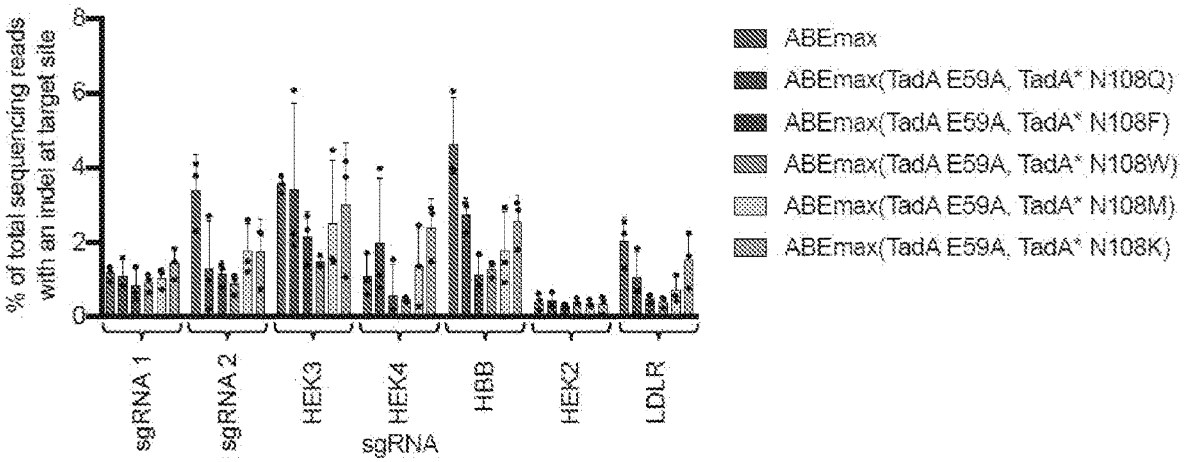
Figure 4D:
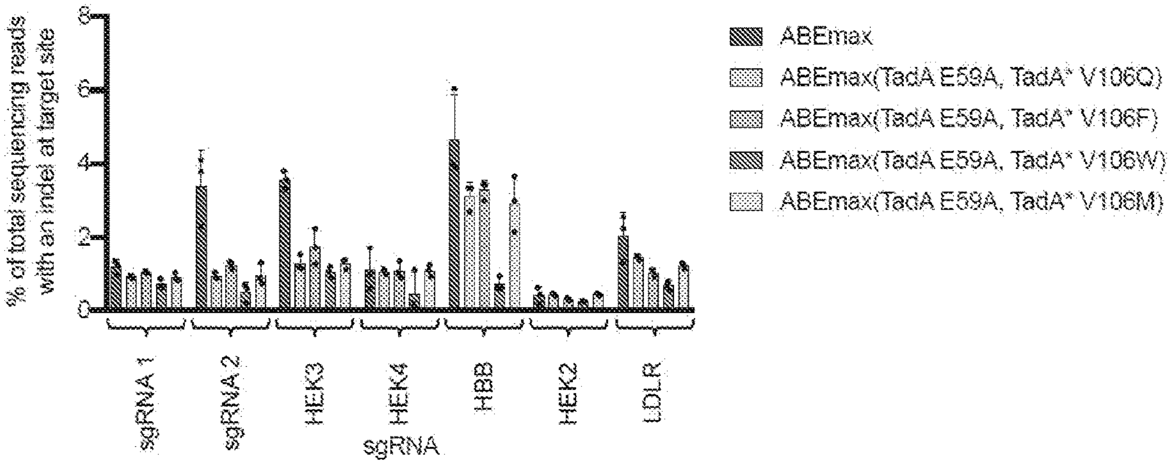
Figure 12:
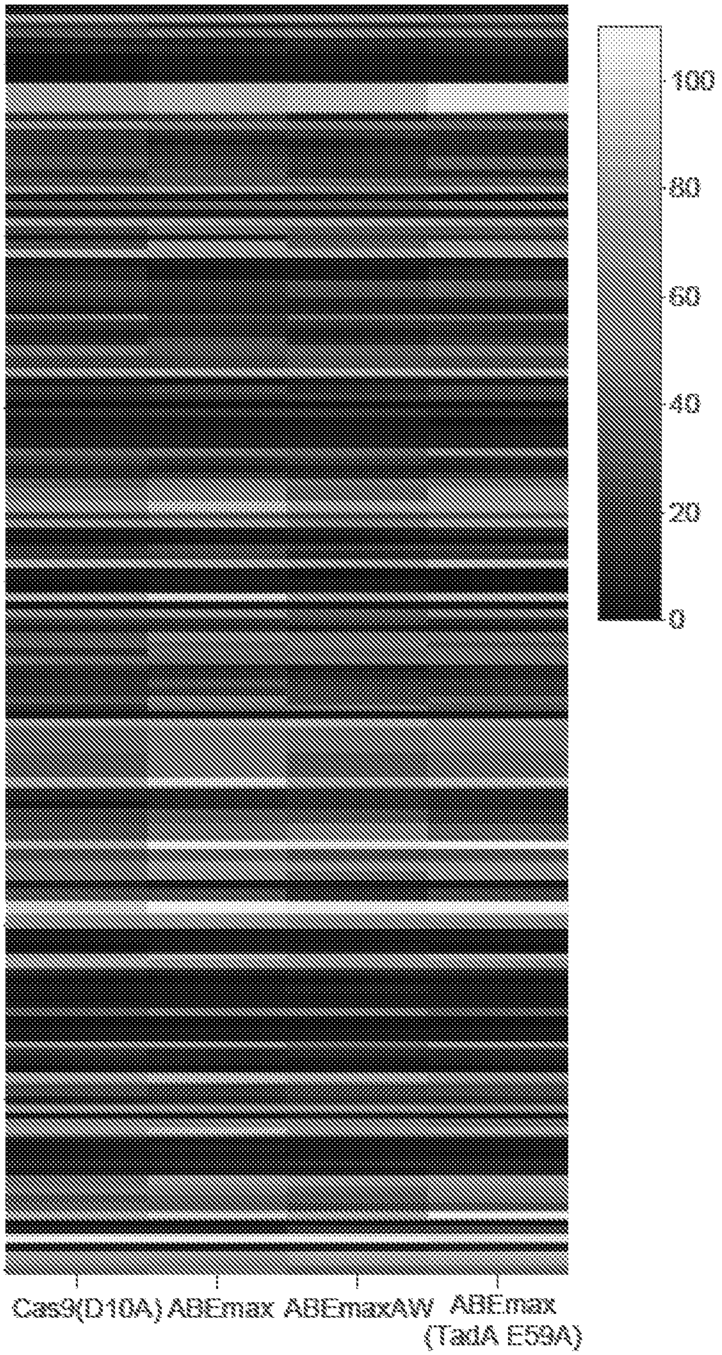
FIG. 12 depicts A-to-I RNA editing across the transcriptome for ABEmax, ABEmaxAW, ABEmax(TadA E59A) and Cas9(D10A). A-to-I variant calls were plotted by transcript location. Bins 1,000,000 nucleotides wide are represented by each colored band. The number of high confidence A-to-I edits per bin are plotted to show the density of A-to-I edits per bin.

In order to determine the potential biological significance of the A-to-I edits observed with ABEmax and ABEmaxAW, the ENSEMBLE Variant Effector Predictor was used to determine where the edits were located within mRNA transcripts in the transcriptome-wide sequencing data (FIG. 3A). The RNA editing associated with ABEmax was spread across the transcriptome and not localized to particular regions (FIG. 12). Only 4.2% of the A-to-I edits were in a protein coding region; of these, 69% lead to coding changes (FIG. 3B). Next, SIFT was used to predict the impact of these coding changes on protein function, revealing that 58% of the coding A-to-I mutations are predicted to have a deleterious impact on protein function (FIG. 3C). In total ABEmax induced 1,138 A-to-I mutations predicted to be deleterious to protein function, compared to 535 for Cas9 (D10A) alone. This was reduced to 727 for ABEmaxAW (FIG. 3C). Mutations in the 3' or 5' UTR can also be deleterious to protein function, but the effects of such mutations are not readily predictable(30). Finally, it is noted that the biological consequence even of mutations that genuinely impair protein function are likely to be minimized by the very low average A-to-I RNA editing frequency of 0.21% for ABEmax, and 0.14% for ABEmaxAW, compared to 0.13% for the Cas9(D10A) nickase-only control.

Materials and Methods for Examples 1-5

Plasmid Construction

All mammalian cell expression plasmids were constructed by USER cloning from gBlock gene fragments (Integrated DNA Technologies), as previously described (32). Phusion U Green Multiplex PCR Master Mix (ThermoFisher) was used for amplification of DNA. sgRNA plasmids were constructed by blunt end ligation of a linear PCR product generated by encoding the 20-nt variable protospacer sequence onto the 5' end of an amplification primer and treating the resulting piece to KLD Enzyme Mix (New England Biolabs) according to the manufacturers' instruction. Machi chemically competent *E. coli* (ThermoFisher) cells were used for plasmid construction.

Mammalian Cell Culture

All cells were cultured and maintained at 37° C. with 5% CO2. Antibiotics were not used for cell culture. HEK293T cells (ATCC CRL-3216) and HeLa cells (ATCC CCL-2) were cultured in Dulbecco's modified Eagle's medium (DMEM) plus GlutaMax (ThermoFisher) supplemented with 10% (v/v) fetal bovine serum (FBS). K562 cells (ATCC CCL-243) were cultured in Roswell Park Memorial Institute (RPMI) 1640 Medium plus GlutaMax (ThermoFisher) supplemented with 10% (v/v) fetal bovine serum (FBS). U2OS cells (ATCC HTB-96) were cultured in MyCoy's 5A Medium plus GlutaMax (ThermoFisher) supplemented with 10% (v/v) fetal bovine serum (FBS).

Preparation of Plasmids for Mammalian Cell Transfection

To obtain endotoxin-free plasmids for transfection, 45 mL of MachI cells (ThermoFisher) expressing freshly-transformed plasmid were pelleted by centrifugation (6000 g, 5 minutes, 4° C.) and purified using ZymoPURE II Plasmid Midi Prep Kits (Zymo Research), according to the manufacturer's instructions with the inclusion of the optional step of passing the plasmid across the EndoZero Spin column (Zymo Research). Plasmid yield was quantified using a Nanodrop and by electrophoresis on a 1% agarose Tris/Borate/EDTA gel supplemented with ethidium bromide.

Mammalian Cell Lipofection and Genomic DNA Isolation

HEK293T cells were seeded on 48-well poly-D-lysine coated plates (Corning) 18-20 hours before lipofection. Lipofection was performed at a cell density of 65%. Unless otherwise stated, cells were transfected with 462 ng of nuclease- or base-editor expression plasmid DNA, 138 ng of sgRNA expression plasmid DNA, and 100 ng of TadA-dimer expression plasmid if this was included for "in trans" analysis of RNA editing. 1.4 μL Lipofectamine 2000 (ThermoFisher) was used per well. Cells were harvested 48 hours or 5 days, as indicated, after transfection.

HeLa cells were seeded in 250 μL of media on 48-well collagen coated plates (Corning) at a density of 70,000-80,000 cells per mL 20-24 hours before lipofection so cells were approximately 85% confluent at the time of transfection. A total of 200 ng of plasmid was used per well, consisting of a mixture of 154 ng of base editor or Cas9 nickase plasmid and 46 ng of sgRNA expression vector plasmid. 1 μL of HeLafect (OZ Biosciences) was used per well according to the manufacturer's instructions. DNA extraction was performed exactly as described above for HEK293T cells.

Genomic DNA Isolation

Media was removed and cells were washed once with 1×DPBS (ThermoFisher). Genomic DNA extraction was performed by addition of 100 μL freshly prepared lysis buffer (10 mM Tris-HCl, pH 7.0, 0.05% SDS, 25 μg/ml Proteinase K (Sigma Aldrich)) directly into the 48-well culture well. The extraction solution was incubated at 37° C. for 60 minutes and then 80° C. for 20 minutes.

Figure 13A:
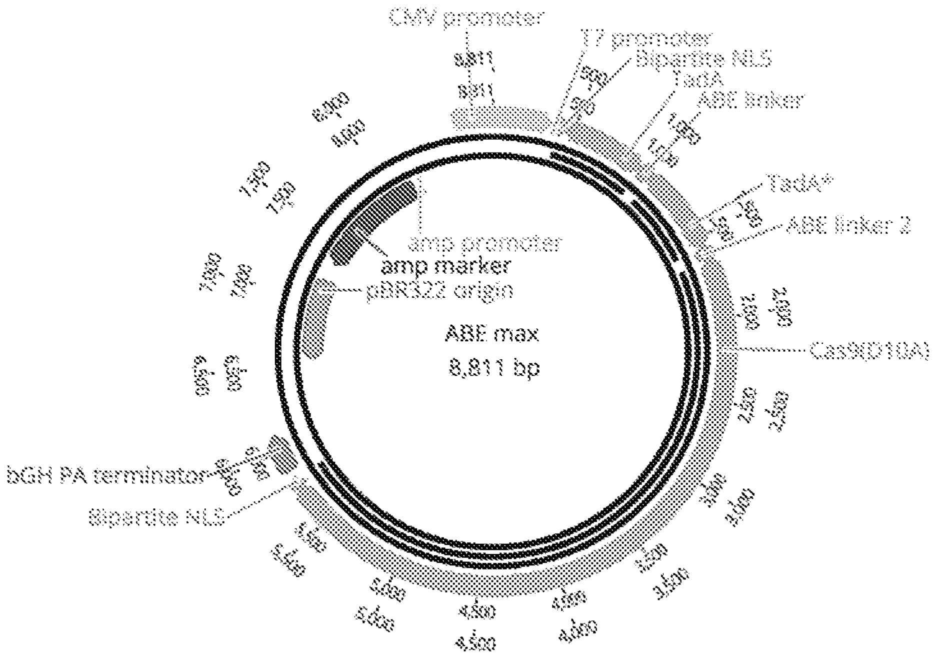
FIGS. 13A to 13B show plasmid maps including the architecture of ABEmax (FIG. 13A) and ABEmaxAW (FIG. 13B).
Figure 13B:
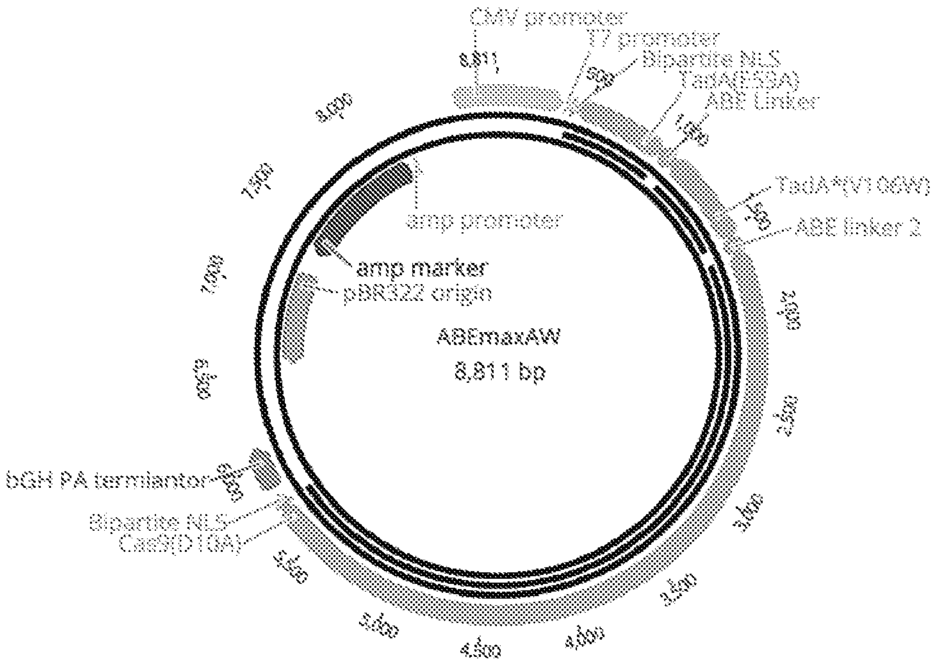

Mammalian Cell Nucleofection 560 ng Cas9(D10A)- or base-editor expression plasmid was combined with 240 ng sgRNA-expression plasmid in a volume that did not exceed 1.5 μL. Detailed plasmid maps for plasmids ABEmax and ABEmaxAW are depicted in FIGS. 13A-13B. This combined plasmid mixture was nucleofected in a final volume of 20 μL per sample in a 16-well Nucleocuvette strip (Lonza). K562 cells were nucleofected using the SF Cell Line 4D-Nucleofector X Kit (Lonza) with $5\times10^5$ cells per sample (program FF-120), according to the manufacturer's protocol. U20S cells were nucleofected using the Nucleofector X Kit with $3\text{-}4\times10^5$ cells per sample (program DN-100), according to the manufacturer's protocol. RNA and DNA were isolated 48 hours post-nucleofection. U20S cells were trypsinized and resuspended in PBS, and K562 cells were directly resuspended in PBS before being spun down by centrifugation (800*g, 2 minutes) to isolate cell pellets. Cell pellets were resuspended in PBS (20 μL) and 3 μL was placed in 50 μL DNA lysis buffer (10 mM Tris-HCl, pH 7.0, 0.05% SDS, 25 g/ml Proteinase K (Sigma Aldrich)), which was incubated on a heat block at 37° C. for 60 minutes and then 80° C. for 20 minutes. The remaining 17 μL of cells suspended in PBS was pelleted again by centrifugation (800*g, 2 minutes) and RNA extraction was begun on these pellets with the addition of RLT Plus Lysis Buffer (Qiagen) to the cell pellet. RNA isolation proceeded with the RNEasy PLUS Mini Kit (Qiagen), as described below.

Rna Isolation from Mammalian Cells

Cells were transfected with the indicated construct, and unless otherwise stated, an sgRNA for the LDLR target site. In the case of HEK293T cells, at the same time as genomic DNA was harvested from one set of wells that had been transfected with editor in combination with LDLR sgRNA, a second set of wells that had undergone identical treatment were lysed for RNA harvest. RNA isolation was performed with the RNeasy PLUS Mini Kit (Qiagen) according to the manufacturer's instructions. In short, RNA isolation began with removal of the culture media and washing of the cells with 1×DBPS (ThermoFisher). 350 μL RLT Plus buffer (Qiagen) was added to each well, cells were homogenized by pipetting and transferred into a DNA eliminator column and the subsequent binding and washing steps for RNA isolation using the RNEasy columns were performed as recommended by the manufacturer. Upon elution of RNA from the RNEasy column with 45 μL of RNAse free water (Qiagen), 2 μL of RNAseOUT inhibitor (ThermoFisher) was added to prevent RNA degradation and RNA was stored at −80° C.

Cdna Generation for Targeted RNA Amplicon Sequencing cDNA generation was performed with SuperScript IV (ThermoFisher) according to the manufacturer's instructions. A poly-T primer was used to selectively amplify mRNAs in the cDNA synthesis step. The optional step of RNAse degradation prior to amplification of cDNAs was included to improve the efficiency of PCR. It is noted that this step was particularly important for RSL1D1 PCR.

Preparation of Genomic DNA and RNA Amplicons for High-Throughput Sequencing (HTS)

A two-step PCR protocol was performed as previously reported (1). In brief, 1 μL of isolated genomic DNA was input into the first round of PCR (PCR1). Phusion U Multiplex Master Mix (Thermo Fisher) was used for both PCR steps. PCR1 was performed with the primers listed in Table 2 for the appropriate sgRNA treatment for 30 cycles with an annealing temperature of 61° C. and an extension time at 72° C. for 15 seconds. Upon verification that PCR1 was successful by running the products on a 2% agarose gel, the barcoding PCR (PCR2) was set up using primers to incorporate barcodes for Illumina sequencing. All primers were ordered from Integrated DNA Technologies (IDT).

After PCR2, up to 240 samples with different barcode combinations were combined and purified by gel extraction using the QIAquick Gel Extraction Kit (Qiagen). A second column was used for full removal of agarose and ethidium bromide before the product was quantified using the QBit ssDNA HS Assay Kit (ThermoFisher) and sequenced using an Illumina MiSeq with 220-260-bp single-end reads.

For RNA, primers were used as listed in Table 2 to amplify the targeted region of cDNA. qPCR was used for all experiments to avoid over-amplification of the cDNA. RSL1D1 required more PCR cycles (34) than IP90 and CTNNB1 (32 each) using the cycling conditions of 98° C. for 1 minute 30 seconds, then cycles of (98° C. for 10 seconds, 60° C. for 15 seconds, and 72° C. for 15 seconds) followed by a final extension of 2 minutes at 72° C. No-RT controls and no-input controls were also processed by qPCR and carried forward onto the MiSeq for each experiment. In no instances did either control exceed 2.5% of the number of aligned reads for the particular experiment when compared to the corresponding RNA samples.

For assessing the number of adenosines within an amplicon that showed greater than 0.1% editing, the % G for each adenosine position was measured and counted in Microsoft Excel using the formula=COUNTIF(C85:HS85,">0.001"), where C85:HS85 represent the range of cells containing the frequency of bases called as a guanosine when the interrogated nucleoside is an adeosnine (for non-adenosine positions the value within the C85:HS85 range is set to zero).

Analysis of HTS Data for DNA Sequencing and Targeted Amplicon Sequencing

Batch analysis with Crispresso2 (33) was used for targeted amplicon and DNA sequencing analysis(33). For DNA analysis, a 30-bp window was used to quantify indels around the DNA nick site. Otherwise, the default parameters were used for analysis. The output file "Reference.NUCLEOTIDE_PERCENTAGE_SUMMARY.txt" was imported into Microsoft Excel for quantification of editing frequencies, and "CRISPRessoBatch_quantification_of_editing_frequency.txt" for quantification of indel frequencies.

For analysis of RNA amplicon editing, no sgRNA flag was used. Instead, the output file "Reference.NUCLEOTIDE_PERCENTAGE_SUMMARY.txt" was imported into Microsoft Excel for analysis of A-to-G editing rates associated with each sample (inosine in RNA is read as a guanosine by polymerases).

Prism (GraphPad) was used to generate dot plots and bar plots of these data. For instances in the text where means have been calculated across multiple genomic or transcriptomic loci, the standard deviations reported represent the standard deviation of the mean for all biological replicates.

Preparation of RNA Libraries for RNA-Seq

Total RNA was applied to Oligo-dT(25) Dynabeads (Thermofisher) to enrich for polyadenylated transcripts. Stranded RNA-seq libraries were generated from these samples using the PrepX mRNA 48 kit (Takara) on the Apollo 324 followed by barcoding and amplification (12 cycles). Following PCR and bead cleanup with AmpureXP beads (Beckman Coulter), libraries were visualized on a 2200 TapeStation (Agilent) and quantified using a Library Quantification Kit (KAPA Biosystems) for multiplexing. libraries were sequenced on a NextSeq high-throughput flowcell (Illumina) as 150 bp paired-end reads.

Rna-Seq Data Analysis

Analysis of the transcriptome-wide editing RNA sequencing data was performed as follows. Prior to the analyses described below, Fastq files were generated using Bcl2Fastq2, then trimmed using Trimmomatic version 0.32 to remove adaptor sequences, unpaired sequences, and low-quality bases. Sam alignments were created using HISAT2 to align paired reads from each of three biological replicates to the hg38 human reference genome (UCSC). Precomputed HISAT2 indexes where obtained from ccb.jhu.edu/software/hisat2/index.shtml. The resulting sam files were sorted and indexed using the samtools software package. Sorted bam alignments from three biological replicates were combined using samtools in order to increase coverage and provide high-quality variant calls. Combined bams were randomly down-sampled to 120 million aligned reads for each condition using a random number generator. The standard error of the mean was found by repeated random down-sampling (from the total number of aligned reads to 120 million aligned reads) and measuring the spread in the variant calling results, which arise from different random sampling events.

Variant calling was performed using the freebayes software package version 1.2.0 (github.com/ekg/freebayes), an inherently probabilistic measure which accounts for error. The resulting VCF files were filtered with vcftools to retain only A-to-G variants, common variants, and variant calls with a call quality greater than or equal to 20, thus removing sites with less than a 0.99 probability of corresponding to a position where a real A-to-I edit has occurred. Thus the variant calling performed here considers read depth at a specific adenosine, number of edited reads at that position, mapping quality, and base call quality, and using all of these indicators, returns the probability that there is bona fide RNA editing at that given adenosine.

Effect Prediction of the A-to-I Variants Identified by RNA-Seq

The Variant Effect Predictor (ENSEMBLE) was used to determine the location within a transcript of each A-to-I edit found in the sample treated with either ABEmax, Cas9 (D10A), or ABEmaxAW, and whether the mutation was synonymous or non-synonymous. The category "downstream gene variant" includes mutations found within a region 5 kb downstream of the start of a gene and the category "upstream gene variant" includes mutations found in the region 5 kb upstream of a protein-coding region. "Intergenic regions" includes A-to-I mutations occurring in non-coding regions more than 5 kb away from the beginning or end of a coding region. SIFT (sift.bii.a-star.edu.sg) was used to predict the outcome of non-synonymous mutations on protein function. High and low confidence calls were made using standard SIFT parameters.

Calculation of the Average Frequency of A-to-I Editing Across the Transcriptome

To calculate the average frequency of A-to-I RNA editing among adenosines sequenced in transcriptome-wide sequencing analysis, REDItools were used to quantify the % A-to-I editing in each sample (github.com/tflati/reditools2.0). All nucleotides were removed except adenosines from the analysis, and then removed all adenosines with a read coverage less than 20 to avoid errors due to low sampling. Next, the number of adenosines converted to an inosine in each sample were calculated and this number was divided by the total number of adenosines in the dataset after filtering to obtain a percentage of adenosines edited to inosine in the transcriptome. Calculation of s.e.m. was performed as described in the variant calling section.

Analysis of the Transcriptome-Wide Position of A-to-I Edits

The transcriptome-wide RNA sequencing data was demultiplexed and aligned as described above. Bins 1,000, 0000 nucleotides wide were created along the human genome using bedtools makewindows. The high confidence A-to-I edits were counted per bin using bedtools coverage. Finally, the data was plotted in R using plot_ly and Ideoviz, to show SNP density per bin.

TABLE 1

Guide RNA sequences. PAM sequences are in italics. For sgRNA LDLR, a 5' G was included in the sgRNA expression cassette to enable efficient expression of the sgRNA from the U6 promoter. This 5' G is indicated as [G].

| sgRNA name | sgRNA + PAM sequence |
|---|---|
| sgRNA 1 | GAGCAAAGAGAATAGACTGTA*GG* (SEQ ID NO: 3) |
| sgRNA 2 | GGATTGACCCAGGCCAGGGC*TGG* (SEQ ID NO: 4) |
| HEK2 | GAACACAAAGCATAGACTGC*CGG* (SEQ ID NO: 5) |
| HEK3 | GGCCCAGACTGAGCACGTGA*TGG* (SEQ ID NO: 6) |
| HEK4 | GGCACTGCGGCTGGAGGTGG*GGG* (SEQ ID NO: 7) |
| HBB | GTAACGGCAGACTTCTCCTC*AGG* (SEQ ID NO: 8) |
| LDLR | [G]CAGAGCACTGGAATTCGTCA*GGG* (SEQ ID NO: 9) |

TABLE 2

Primers used for amplification of genomic DNA or cDNA for HTS. Primers for amplification of genomic DNA or cDNA

| | |
|---|---|
| LDLR forward | ACACTCTTTCCCTACACGACGCTCTTCCGATCTNNNNNGCCCTGCTTCTTTTTCTCTGGT (SEQ ID NO: 10) |
| LDLR reverse | TGGAGTTCAGACGTGTGCTCTTCCGATCTACCATTAACGCAGCCAACTTCA (SEQ ID NO: 11) |
| HBB forward | ACACTCTTTCCCTACACGACGCTCTTCCGATCTNNNNNGTCTTCTCTGTCTCCACATGCC (SEQ ID NO: 12) |
| HBB reverse | TGGAGTTCAGACGTGTGCTCTTCCGATCTTAGGGTTGGCCAATCTACTCCC (SEQ ID NO: 13) |
| HEK site 3 and sgRNA 2 forward | ACACTCTTTCCCTACACGACGCTCTTCCGATCTNNNNNGGAAACGCCCATGCAATTAGTC (SEQ ID NO: 14) |
| HEK site 3 and sgRNA 2 reverse | TGGAGTTCAGACGTGTGCTCTTCCGATCTCTTGTCAACCAGTATCCCGGTG (SEQ ID NO: 15) |

TABLE 2-continued

Primers used for amplification of genomic DNA or cDNA for HTS. Primers for amplification of genomic DNA or cDNA

| | |
|---|---|
| HEK site 2 forward | ACACTCTTTCCCTACACGACGCTCTTCCGATCTNNNNNTGAATGGATTCCTTGGAAACAATG (SEQ ID NO: 16) |
| HEK site 2 reverse | TGGAGTTCAGACGTGTGCTCTTCCGATCTCCAGCCCCATCTGTCAAACT (SEQ ID NO: 17) |
| HEK site 4 forward | TGGAGTTCAGACGTGTGCTCTTCCGATCTTCCTTTCAACCCGAACGGAG (SEQ ID NO: 18) |
| HEK site 4 reverse | ACACTCTTTCCCTACACGACGCTCTTCCGATCTNNNNNGCTGGTCTTCTTTCCCCTCC (SEQ ID NO: 19) |
| sgRNA 1 forward | ACACTCTTTCCCTACACGACGCTCTTCCGATCTNNNNNGAGTTACTGCTCAGACATGTAA (SEQ ID NO: 20) |
| sgRNA 1 reverse | TGGAGTTCAGACGTGTGCTCTTCCGATCTGACCTCGTGATCCACCTGCC (SEQ ID NO: 21) |
| CTNNB1 forward | ACACTCTTTCCCTACACGACGCTCTTCCGATCTNNNNNATTTGATGGAGTTGGACATGGCC (SEQ ID NO: 22) |
| CTNNB1 reverse | TGGAGTTCAGACGTGTGCTCTCCAGCTACTTGTTCTTGAGTGAAGG (SEQ ID NO: 23) |
| RSL1D1 forward | ACACTCTTTCCCTACACGACGCTCTTCCGATCTNNNNNTGGCTTTCCAAATCAGTGGGTC (SEQ ID NO: 24) |
| RSL1D1 reverse | TGGAGTTCAGACGTGTGCTCTTCCGATCTCTCATAAGCTTAGACCAACAAGC (SEQ ID NO: 25) |
| IP90 forward | ACACTCTTTCCCTACACGACGCTCTTCCGATCTNNNNNCTGGTTGACCAATCTGTGGTG (SEQ ID NO: 26) |
| IP90 reverse | TGGAGTTCAGACGTGTGCTCTCTGCGTCTGGATCAGGTACG (SEQ ID NO: 27) |

TABLE 3

List of amplicon sequences used for alignment and analysis of HTS reads.

| DNA or RNA site | Amplicon sequence |
|---|---|
| HEK4 | TGGTCTTCTTTCCCCTCCCCTGCCCTCCCC<br>TCCCTTCAAGATGGCTGACAAAGGCCGGGC<br>TGGGTGGAAGGAAGGGAGGAAGGGCGAGGC<br>AGAGGGTCCAAAGCAGGATGACAGGCAGGG<br>GCACCGCGGCGCCCCGGTGGCACTGCGGCT<br>GGAGGTGGGGGTTAAAGCGGAGACTCTGGT<br>GCTGTGTGACTACAGTGGGGGCCCTGCCCT<br>CTCTGAGCCCCCGCCTCCAGGCCTGTGTGT<br>GTGT<br>(SEQ ID NO: 28) |
| HEK3 | GGAAACGCCCATGCAATTAGTCTATTTCTG<br>CTGCAAGTAAGCATGCATTTGTAGGCTTGA<br>TGCTTTTTTTCTGCTTCTCCAGCCCTGGCC<br>TGGGTCAATCCTTGGGGCCCAGACTGAGCA<br>CGTGATGGCAGAGGAAAGGAAGCCCTGCTT<br>CCTCCAGAGGGCGTCGCAGGACAGCTTTTC<br>CTAGACAGGGGCTAGTATGTGCAGCTCCTG<br>CACCGGGATACTGGTTGACAAG<br>(SEQ ID NO: 29) |
| HEK2 | TGAATGGATTCCTTGGAAACAATGATAACA<br>AGACCTGGCTGAGCTAACTGTGACAGCATG<br>TGGTAATTTTCCAGCCCGCTGGCCCTGTAA<br>AGGAAACTGGAACACAAAGCATAGACTGCG<br>GGGCGGGCCAGCCTGAATAGCTGCAAACAA<br>GTGCAGAATATCTGATGATGTCATACGCAC<br>AGTTTGACAGATGGGGCTGG<br>(SEQ ID NO: 30) |
| LDLR | GCCCTGCTTCTTTTTCTCTGGTTGTCTCTT<br>CTTGAGAAAATCAACACACTCTGTCCTGTT<br>TTCCAGCTGTGGCCACCTGTCGCCCTGACG<br>AATTCCAGTGCTCTGATGGAAACTGCATCC<br>ATGGCAGCCGGCAGTGTGACCGGGAATATG<br>ACTGCAAGGACATGAGCGATGAAGTTGGCT<br>GCGTTAATGGT<br>(SEQ ID NO: 31) |
| HBB | CTTCTCTGTCTCCACATGCCCAGTTTCTAT<br>TGGTCTCCTTAAACCTGTCTTGTAACCTTG<br>ATACCAACCTGCCCAGGGCCTCACCACCAA<br>CTTCATCCACGTTCACCTTGCCCCACAGGG<br>CAGTAACGGCAGACTTCTCCTCAGGAGTCA<br>GATGCACCATGGTGTCTGTTTGAGGTTGCT<br>AGTGAACACAGTTGTGTCAGAAGCAAATGT<br>AAGCAATAGATGGCTCTGCCCTGACTTTTA<br>TGCCCAGCCCTGGCTCCTGCCCTCCCTGCT<br>CCTGGGAGTAGATTGGCCAA<br>(SEQ ID NO: 32) |
| sgRNA 1 | GTTACTGCTCAGACATGTAATAATAATAAA<br>TAACACATCAAATAACCATACCATTTTAAG<br>CTGTAGTATTATGAAGGGAAATCTGGAGCA<br>AAGAGAATAGACTGTAGGGAAACCAGTTAA<br>GAAATAGGACATGGAGGCTAGGTGCAGTGG<br>CTCACGCCTGTAATCGCAGCACTTTGGGAG<br>GCTGAGGCAGGTGGATCACGAGG<br>(SEQ ID NO: 33) |
| sgRNA 2 | GGAAACGCCCATGCAATTAGTCTATTTCTG<br>CTGCAAGTAAGCATGCATTTGTAGGCTTGA<br>TGCTTTTTTTCTGCTTCTCCAGCCCTGGCC<br>TGGGTCAATCCTTGGGGCCCAGACTGAGCA<br>CGTGATGGCAGAGGAAAGGAAGCCCTGCTT<br>CCTCCAGAGGGCGTCGCAGGACAGCTTTTC<br>CTAGACAGGGGCTAGTATGTGCAGCTCCTG<br>CACCGGGATACTGGTTGACAAG<br>(SEQ ID NO: 34) |
| RSL1D1 | TTGGCTTTCCAAATCAGTGGGTCTGACTTG<br>AGGTCTGTGATGTGACCCTTTTCCTCACCT<br>GCTCAACCATTATTCACATGGACTCCATCA<br>TATTCATTTGTAGTCATTCCCAGAGTGGCC<br>CAGTGAGGGTCTCGCTGTATGAGAGTCGGC<br>TACGGAATTTAGGAGAAACAGAAGTTTCTT<br>GGCTTTCATGCTGAGCTTGTTGGTCTAAGC<br>TTATGAG<br>(SEQ ID NO: 35) |
| CTNNB1 | TTTGATGGAGTTGGACATGGCCATGGAACC<br>AGACAGAAAAGCGGCTGTTAGTCACTGGCA<br>GCAACAGTCTTACCTGGACTCTGGAATCCA<br>TTCTGGTGCCACTACCACAGCTCCTTCTCT<br>GAGTGGTAAAGGCAATCCTGAGGAAGAGGA<br>TGTGGATACCTCCCAAGTCCTGTATGAGTG<br>GAACAGGGATTTTCTCAGTCCTTCACTCAA<br>GAACAAGTAGCTGG<br>(SEQ ID |
| IP90 | CTGGTTGACCAATCTGTGGTGAATAGTGGA<br>AATCTGCTCAATGACATGACTCCTCCTGTA<br>AATCCTTCACGTGAAATTGAGGACCCAGAA<br>GACCGGAAGCCCGAGGATTGGGATGAAAGA<br>CCAAAAATCCCAGATCCAGAAGCTGTCAAG<br>CCAGATGACTGGGATGAAGATGCCCCTGCT<br>AAGATTCCAGATGAAGAGGCCACAAAACCC<br>GAAGGCTGGTTAGATGATGAGCCTGAGTAC<br>GTAC<br>(SEQ ID NO: 37) |

TABLE 4

List of primers used to amplify genomic off-target loci. These primers have been published previously (1, 2) but are listed here for completeness.

| Target site | Primer sequence |
|---|---|
| forward HEK site2 off1 | ACACTCTTTCCCTACACGAC<br>GCTCTTCCGATCTNNNNGTG<br>TGGAGAGTGAGTAAGCCA<br>(SEQ ID NO: 38) |
| reverse HEK site2 off1 | TGGAGTTCAGACGTGTGCTC<br>TTCCGATCTACGGTAGGATG<br>ATTTCAGGCA<br>(SEQ ID NO: 39) |
| forward HEK site2 off2 | ACACTCTTTCCCTACACGAC<br>GCTCTTCCGATCTNNNNCAC<br>AAAGCAGTGTAGCTCAGG<br>(SEQ ID NO: 40) |
| reverse HEK site2 off2 | TGGAGTTCAGACGTGTGCTC<br>TTCCGATCTTTTTTGGTACT<br>CGAGTGTTATTCAG<br>(SEQ ID NO: 41) |
| forward HEK site3 off1 | ACACTCTTTCCCTACACGAC<br>GCTCTTCCGATCTNNNNTCC<br>CCTGTTGACCTGGAGAA<br>(SEQ ID NO: 42) |
| reverse HEK site3 off1 | TGGAGTTCAGACGTGTGCTC<br>TTCCGATCTCACTGTACTTG<br>CCCTGACCA<br>(SEQ ID NO: 43) |
| forward HEK site3 off2 | ACACTCTTTCCCTACACGAC<br>GCTCTTCCGATCTNNNNTTG<br>GTGTTGACAGGGAGCAA<br>(SEQ ID NO: 44) |

TABLE 4-continued

List of primers used to amplify genomic off-target loci. These primers have been published previously (1, 2) but are listed here for completeness.

| Target site | Primer sequence |
|---|---|
| reverse HEK site3 off2 | TGGAGTTCAGACGTGTGCTC TTCCGATCTCTGAGATGTGG GCAGAAGGG (SEQ ID NO: 45) |
| forward HEK site3 off3 | ACACTCTTTCCCTACACGAC GCTCTTCCGATCTNNNNTGA GAGGGAACAGAAGGGCT (SEQ ID NO: 46) |
| reverse HEK site3 off3 | TGGAGTTCAGACGTGTGCTC TTCCGATCTGTCCAAAGGCC CAAGAACCT (SEQ ID NO: 47) |
| forward HEK site3 off4 | ACACTCTTTCCCTACACGAC GCTCTTCCGATCTNNNNTCC TAGCACTTTGGAAGGTCG (SEQ ID NO: 48) |
| reverse HEK site3 off4 | TGGAGTTCAGACGTGTGCTC TTCCGATCTGCTCATCTTAA TCTGCTCAGCC (SEQ ID NO: 49) |
| forward HEK site3 off5 | ACACTCTTTCCCTACACGAC GCTCTTCCGATCTNNNNAAA GGAGCAGCTCTTCCTGG (SEQ ID NO: 50) |
| reverse HEK site3 off5 | TGGAGTTCAGACGTGTGCTC TTCCGATCTGTCTGCACCAT CTCCCACAA (SEQ ID NO: 51) |
| forward HEK site4 off1 | ACACTCTTTCCCTACACGAC GCTCTTCCGATCTNNNNGGC ATGGCTTCTGAGACTCA (SEQ ID NO: 52) |
| reverse HEK site4 off1 | TGGAGTTCAGACGTGTGCTC TTCCGATCTGTCTCCCTTGC ACTCCCTGTCTTT (SEQ ID NO: 53) |
| forward HEK site4 off2 | ACACTCTTTCCCTACACGAC GCTCTTCCGATCTNNNNTTT GGCAATGGAGGCATTGG (SEQ ID NO: 54) |
| reverse HEK site4 off2 | TGGAGTTCAGACGTGTGCTC TTCCGATCTGAAGAGGCTGC CCATGAGAG (SEQ ID NO: 55) |
| forward HEK site4 off3 | ACACTCTTTCCCTACACGAC GCTCTTCCGATCTNNNNGGT CTGAGGCTCGAATCCTG (SEQ ID NO: 56) |
| reverse HEK site4 off3 | TGGAGTTCAGACGTGTGCTC TTCCGATCTCTGTGGCCTCC ATATCCCTG (SEQ ID NO: 57) |
| forward HEK site4 off4 | ACACTCTTTCCCTACACGAC GCTCTTCCGATCTNNNNTTT CCACCAGAACTCAGCCC (SEQ ID NO: 58) |
| reverse HEK site4 off4 | TGGAGTTCAGACGTGTGCTC TTCCGATCTCCTCGGTTCCT CCACAACAC (SEQ ID NO: 59) |
| forward HEK site4 off5 | ACACTCTTTCCCTACACGAC GCTCTTCCGATCTNNNNCAC GGGAAGGACAGGAGAAG (SEQ ID NO: 60) |
| reverse HEK site4 off5 | TGGAGTTCAGACGTGTGCTC TTCCGATCTGCAGGGGAGGG ATAAAGCAG (SEQ ID NO: 61) |

TABLE 5

List of interrogated off-target genomic loci (31), with guide RNA sequences and amplicons used for alignment.

| Name | sgRNA | Amplicon sequence |
|---|---|---|
| HEK site2 off1 | GAACACAATGC ATAGATTGC (SEQ ID NO: 62) | GTGTGGAGAGTGAGTAAGCCAGAAC ACAATGCATAGATTGCCGGTAAATA GGTTTAGATTCATCCATTTTTAAAA AATGGTGTGGGAGCATTAAATATGT ATATAGTAGATATGGAAAAATGATT CTCATAATAACTGACATTTCTGTTT CACAAGAAAATTATTTTACATTATA TGTATATTTTACATAAATTATACAT AGTCATTTAAAAAGCTCAAATAGTG CAAAAACAATATGGAGAATTGCCTG AAATCATCCTACCGT (SEQ ID NO: 63) |
| HEK site2 off2 | AAACATAAAGC ATAGACTGC (SEQ ID NO: 64) | CACAAAGCAGTGTAGCTCAGGGAAG GAGCAGTGAGTTTGGGCACTTGTGA CAGAATAGTGGGACTATGCCAGAGA TACACAGGAGGAGGTGGTACCTTCT AGCTCCCCCTCAAAACATAAAGCAT AGACTGCAAAGTACTCCCAAGCAGG CTGAATAACACTCGAGTACCAAAAA (SEQ ID NO: 65) |
| HEK site3 off1 | CACCCAGACTG AGCACGTGC (SEQ ID NO: 66) | TCCCCTGTTGACCTGGAGAAGCATG AACCAGTCAAAAAGTTTAAAGACAA GAGCATTAACTGCACCAGTGGGCAG CTCAGCTCAGACACCAGTAGCGTGG GCACCCAGACTGAGCACGTGCTGGA GCCCAAGAAATGCAGAGACCTGTGC ACCTCTGGTCAGGGCAAGTACAGTG (SEQ ID NO: 67) |
| HEK site3 off2 | GACACAGACCG GGCACGTGA (SEQ ID NO: 68) | TTGGTGTTGACAGGGAGCAACTTCA CAGTCCCAGGCATCAGGACACAGAC CGGGCACGTGAGGGAAGCCCAAGGG AGAGGACTGGTGTAATCGAGGCTGA CTCCACTTTTAATGTTTGACTGATG ATAGGTTTCAAGTCTCACTAAGTCT CCTTCCCCTTCTGCCCACATCTCAG (SEQ ID NO: 69) |

TABLE 5-continued

List of interrogated off-target genomic loci (31), with guide RNA sequences and amplicons used for alignment.

| Name | sgRNA | Amplicon sequence |
|---|---|---|
| HEK site3 off3 | AGCTCAGACTGAGCAAGTGA (SEQ ID NO: 70) | TGAGAGGGAACAGAAGGGCTAAGACTAAAAGGAACAGAGGAGTTCATAGTGAGCGGTAAAGAGCTCAGACTGAGCAAGTGAGGGGCTCAGCCTCCCATGGAGGACAGGGGGCTGGGGCCCCTGGCTGATGTCTGGACTGAAGCCCCCACGCCCAGAGGTTCTTGGGCCTTTGGAC (SEQ ID NO: 71) |
| HEK site3 off4 | AGACCAGACTGAGCAAGAGA (SEQ ID NO: 72) | CCTAGCACTTTGGAAGGTCGAAGCGGCAGGATGGCTTCAACCCAGGAGTTCGAGACCAGACTGAGCAAGAGAGGGAGAGTGTCTGTATTAACAACAAACAAACAAACAAAAAACTAAACTAAAAGAAACTGTGGTGTATAATATAAAATTCTGGCTGAGCAGATTAAGATGAGC (SEQ ID NO:73) |
| HEK site3 off5 | GAGCCAGAATGAGCACGTGA (SEQ ID NO: 74) | AAAGGAGCAGCTCTTCCTGGTGGAAATTGCGAGCAGAGGCTGCGTGAGTTCCGTAACTCGCACACAGCCTCCATTTGGAGCCAGAATGAGCACGTGAGGGACCCCGGGCAGAGGGGCCAGTGCTGACATTATGCTCCATGCAACCTCCCATCCTGTTGTGGGAGATGGTGCAGAC (SEQ ID NO: 75) |
| HEK site2 offl | TGCACTGCGGCCGGAGGAGG (SEQ ID NO: 76) | GGCATGGCTTCTGAGACTCATAGCTGGGGCTGAAGATCCCTAGGGGGGCTCTGCTGGGCTCACTGCTCTCCAGAGTGGTCCAGCCCGGCTGCAGGGTGCTGCTTCCAGCTTGGTGCACTGCGGCCGGAGGAGGTGGAGGATGGAAAGTAAGATTCAAAGACAGGGAGTGCAAGGG (SEQ ID NO: 77) |
| HEK site2 off2 | GGCT CT GCGGCTGGAGGGGG (SEQ ID NO: 78) | TTTGGCAATGGAGGCATTGGGCAGGGGAAGCCTGTCTTCAGGGCACATGCACGTGCGCAGGGCTCTGCGGCTGGAGGGGGTGGGGTTGCTGTTAGTGACAGGGGCCCCAGCCAGGCAGGTTTCAGGATTGGGGAGCACTTGCTTCGGCTCCCTTGCTCTCATGGGCAGCCTCTTC (SEQ ID NO: 79) |
| HEK site2 off3 | GGCACGACGGCTGGAGGTGG (SEQ ID NO: 80) | GGTCTGAGGCTCGAATCCTGGCAGCAGGTCCTTCATGGCAAGGCGGGAAAAGAGAAAAGCCAACGGGTTCTCATGCTGGGAAAAGATGCCGGGCACGACGGCTGGAGGTGGGGGGTTGGGAGTGGGTGGGATGCTTGCGTGCCCTGCATGAGGTGCAGGGATATGGAGGCCACAG (SEQ ID NO: 81) |
| HEK site2 off4 | GGCATCACGGCTGGAGGTGG (SEQ ID NO: 82) | TTCCACCAGAACTCAGCCCAGGCTGCTGTGGGATGGAATCACCTGCACCCGGATGTTCTTTCTGGGCTGGTACATACAGGCAAGGCATCACGGCTGGAGGTGGAGGGGGCCTAACCCGGGGTTGCCCAGGAAGGGGTTTGCACATGGATTCGGTGTGTTGTGGAGGAACCGAGG (SEQ ID NO: 83) |
| HEK site2 pff5 | GGCGCTGCGGCGGGAGGTGG (SEQ ID NO: 84) | CACGGGAAGGACAGGAGAAGGTGCTGGACCGCCTGGACTTTGTGCTGACCAGCCTTGTGGCGCTGCGGCGGGAGGTGGAGGAGCTGAGAAGCAGCCTGCGAGGGCTTGCGGGGGAGATTGTTGGGGAGGTCCGGTGAGTAATGCGGCTTCTTCTCCTGCTTTATCCCTCCCCTGC (SEQ ID NO: 85) |

TABLE 6

List of plasmid accession numbers from Addgene.

| Plasmid name | Addgene number |
|---|---|
| pCMV-TadA-TadA* | 125661 |
| pCMV-ABEmax(TadA E59A, TadA*R47M) | 125660 |
| pCMV-ABEmax(TadA E59A, TadA*R47W) | 125659 |
| pCMV-ABEmax(TadA E59A, TadA*R47F) | 125658 |
| pCMV-ABEmax(TadA E59A, TadA*R47Q) | 125657 |
| pCMV-ABEmax(TadA E59A, TadA*D108M) | 125656 |
| pCMV-ABEmax(TadA E59A, TadA*D108Q) | 125655 |
| pCMV-ABEmax(TadA E59A, TadA*D108F) | 125654 |
| pCMV-ABEmax(TadA E59A, TadA*D108W) | 125653 |
| pCMV-ABEmax(TadA E59A, TadA*V106F) | 125652 |
| pCMV-ABEmax(TadA E59A, TadA*V106Q) | 125651 |
| pCMV-ABEmax(TadA E59A, TadA*V106M) | 125650 |
| pCMV-ABEmax(TadA E59A, TadA*E59A) | 125649 |
| pCMV-ABEmax(TadA E59A) | 125648 |
| pCMV-ABEmaxAW | 125647 |
| PCMV-ABEmax(TadA, TadA*E59A) | 125662 |

REFERENCES

1. N. M. Gaudelli et al., Programmable base editing of A*T to G*C in genomic DNA without DNA cleavage. Nature 551, 464-471 (2017).
2. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
3. H. A. Rees, D. R. Liu, Base editing: precision chemistry on the genome and transcriptome of living cells. Nat Rev Genet, (2018).
4. T. Lindahl, Instability and decay of the primary structure of DNA. Nature 362, 709-715 (1993).
5. M. J. Landrum et al., ClinVar: public archive of interpretations of clinically relevant variants. Nucleic Acids Res 44, D862-868 (2016).
6. L. W. Koblan et al., Improving cytidine and adenine base editors by expression optimization and ancestral reconstruction. Nat Biotechnol, (2018).
7. J. H. Hu et al., Evolved Cas9 variants with broad PAM compatibility and high DNA specificity. Nature 556, 57-63 (2018).
8. S. M. Ryu et al., Adenine base editing in mouse embryos and an adult mouse model of Duchenne muscular dystrophy. Nat Biotechnol, (2018).
9. C.-Q. Song et al., Adenine base editing in an adult mouse model of tyrosinaemia. Nature Biomedical Engineering, (2019).
10. B. C. Kang et al., Precision genome engineering through adenine base editing in plants. Nat Plants, (2018).
11. Z. Liu et al., Highly efficient RNA-guided base editing in rabbit. Nat Commun 9, 2717 (2018).
12. L. Yang et al., Increasing targeting scope of adenosine base editors in mouse and rat embryos through fusion of TadA deaminase with Cas9 variants. Protein Cell 9, 814-819 (2018).

13. W. Qin et al., Precise A*T to G*C base editing in the zebrafish genome. BMC Biol 16, 139 (2018).
14. M. P. Zafra et al., Optimized base editors enable efficient editing in cells, organoids and mice. Nat Biotechnol 36, 888-893 (2018).
15. L. W. Koblan et al., Improving cytidine and adenine base editors by expression optimization and ancestral reconstruction. Nat Biotechnol 36, 843-846 (2018).
16. P. Liang et al., Genome-wide profiling of adenine base editor specificity by EndoV-seq. Nat Commun 10, 67 (2019).
17. S. Jin et al., Cytosine, but not adenine, base editors induce genome-wide off-target mutations in rice. Science, (2019).
18. E. Zuo et al., Cytosine base editor generates substantial off-target single-nucleotide variants in mouse embryos. Science, (2019).
19. D. Kim, D.-e. Kim, G. Lee, S.-I. Cho, J.-S. Kim, Genome-wide target specificity of CRISPR RNA-guided adenine base editors. Nature Biotechnology, (2019).
20. S. M. Ryu et al., Adenine base editing in mouse embryos and an adult mouse model of Duchenne muscular dystrophy. Nat Biotechnol 36, 536-539 (2018).
21. Z. Liu et al., Efficient generation of mouse models of human diseases via ABE- and BE-mediated base editing. Nat Commun 9, 2338 (2018).
22. H. A. Rees et al., Improving the DNA specificity and applicability of base editing through protein engineering and protein delivery. Nat Commun 8, 15790 (2017).
23. H. K. Lee et al., Targeting fidelity of adenine and cytosine base editors in mouse embryos. Nat Commun 9, 4804 (2018).
24. W. H. Yeh, H. Chiang, H. A. Rees, A. S. B. Edge, D. R. Liu, In vivo base editing of post-mitotic sensory cells. Nat Commun 9, 2184 (2018).
25. H. C. Losey, A. J. Ruthenburg, G. L. Verdine, Crystal structure of *Staphylococcus aureus* tRNA adenosine deaminase TadA in complex with RNA. Nat Struct Mol Biol 13, 153-159 (2006).'
26. J. Kim et al., Structural and kinetic characterization of *Escherichia coli* TadA, the wobble-specific tRNA deaminase. Biochemistry 45, 6407-6416 (2006).
27. E. Eisenberg, E. Y. Levanon, A-to-I RNA editing—immune protector and transcriptome diversifier. Nat Rev Genet 19, 473-490 (2018).
28. J. J. Ishizuka et al., Loss of ADAR1 in tumours overcomes resistance to immune checkpoint blockade. Nature 565, 43-48 (2019).
29. B. L. Bass, RNA editing by adenosine deaminases that act on RNA. Annu Rev Biochem 71, 817-846 (2002).
30. S. Chatterjee, J. K. Pal, Role of 5'- and 3'-untranslated regions of mRNAs in human diseases. Biol Cell 101, 251-262 (2009).
31. S. Q. Tsai et al., GUIDE-seq enables genome-wide profiling of off-target cleavage by CRISPR-Cas nucleases. Nat Biotechnol 33, 187-197 (2015).
32. A. H. Badran et al., Continuous evolution of *Bacillus thuringiensis* toxins overcomes insect resistance. Nature 533, 58-63 (2016).
33. K. Clement et al., CRISPResso2 provides accurate and rapid genome editing sequence analysis. Nature Biotechnol 37, 224-226 (2019).

EQUIVALENTS AND SCOPE

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The disclosure includes embodiments in which exactly one member of the group is present in, employed in, or otherwise relevant to a given product or process. The disclosure includes embodiments in which more than one, or all of the group members are present in, employed in, or otherwise relevant to a given product or process.

Furthermore, the disclosure encompasses all variations, combinations, and permutations in which one or more limitations, elements, clauses, and descriptive terms from one or more of the listed claims is introduced into another claim. For example, any claim that is dependent on another claim can be modified to include one or more limitations found in any other claim that is dependent on the same base claim. Where elements are presented as lists, e.g., in Markush group format, each subgroup of the elements is also disclosed, and any element(s) can be removed from the group. It should it be understood that, in general, where the disclosure, or embodiments of the disclosure, is/are referred to as comprising particular elements and/or features, certain embodiments of the disclosure or embodiments of the disclosure consist, or consist essentially of, such elements and/or features. For purposes of simplicity, those embodiments have not been specifically set forth in haec verba herein. It is also noted that the terms "comprising" and "containing" are intended to be open and permits the inclusion of additional elements or steps. Where ranges are given, endpoints are included. Furthermore, unless otherwise indicated or otherwise evident from the context and understanding of one of ordinary skill in the art, values that are expressed as ranges can assume any specific value or sub-range within the stated ranges in different embodiments of the disclosure, to the tenth of the unit of the lower limit of the range, unless the context clearly dictates otherwise.

This application refers to various issued patents, published patent applications, journal articles, and other publications, all of which are incorporated herein by reference. If there is a conflict between any of the incorporated references and the present disclosure, the specification shall control. In addition, any particular embodiment of the present disclosure that falls within the prior art may be explicitly excluded from any one or more of the claims. Because such embodiments are deemed to be known to one of ordinary skill in the art, they may be excluded even if the exclusion is not set forth explicitly herein. Any particular embodiment of the disclosure can be excluded from any claim, for any reason, whether or not related to the existence of prior art.

Those skilled in the art will recognize or be able to ascertain using no more than routine experimentation many equivalents to the specific embodiments described herein. The scope of the present embodiments described herein is not intended to be limited to the above Description, but rather is as set forth in the appended claims. Those of ordinary skill in the art will appreciate that various changes and modifications to this description may be made without departing from the spirit or scope of the present disclosure, as defined in the following claims.

SEQUENCE LISTING (259 sequences)

SEQ ID NO: 1 - RNA, 18 nt, Artificial Sequence
  Synthetic
gcucggcuacgaaccgag

SEQ ID NO: 2 - RNA, 19 nt, Artificial Sequence
  Synthetic
agucggcuacggaauuuag

SEQ ID NO: 3 - DNA, 23 bp, Artificial Sequence
  Synthetic
gagcaaagagaatagactgtagg

SEQ ID NO: 4 - DNA, 23 bp, Artificial Sequence
  Synthetic
ggattgacccaggccagggctgg

SEQ ID NO: 5 - DNA, 23 bp, Artificial Sequence
  Synthetic
gaacacaaagcatagactgccgg

SEQ ID NO: 6 - DNA, 23 bp, Artificial Sequence
  Synthetic
ggcccagactgagcacgtgatgg

SEQ ID NO: 7 - DNA, 23 bp, Artificial Sequence
  Synthetic
ggcactgcggctggaggtggggg

SEQ ID NO: 8 - DNA, 23 bp, Artificial Sequence
  Synthetic
gtaacggcagacttctcctcagg

SEQ ID NO: 9 - DNA, 24 bp, Artificial Sequence
  Synthetic
gcagagcactggaattcgtcaggg

SEQ ID NO: 10 - DNA, 59 bp, Artificial Sequence
  Synthetic
  misc_feature (34)..(37): n is a, c, g, or t
acactctttccctacacgacgctcttccgatctnnnngccctgcttctttttctctggt

SEQ ID NO: 11 - DNA, 51 bp, Artificial Sequence
  Synthetic
tggagttcagacgtgtgctcttccgatctaccattaacgcagccaacttca

SEQ ID NO: 12 - DNA, 59 bp, Artificial Sequence
  Synthetic
  misc_feature (34)..(37): n is a, c, g, or t
acactctttccctacacgacgctcttccgatctnnnngtcttctctgtctccacatgcc

SEQ ID NO: 13 - DNA, 51 bp, Artificial Sequence
  Synthetic
tggagttcagacgtgtgctcttccgatcttagggttggccaatctactccc

SEQ ID NO: 14 - DNA, 59 bp, Artificial Sequence
  Synthetic
  misc_feature (34)..(37): n is a, c, g, or t
acactctttccctacacgacgctcttccgatctnnnnggaaacgcccatgcaattagtc

SEQ ID NO: 15 - DNA, 51 bp, Artificial Sequence
  Synthetic
tggagttcagacgtgtgctcttccgatctcttgtcaaccagtatcccggtg

SEQ ID NO: 16 - DNA, 61 bp, Artificial Sequence
  Synthetic
  misc_feature (34)..(37): n is a, c, g, or t
acactctttccctacacgacgctcttccgatctnnnntgaatggattccttggaaacaatg

SEQ ID NO: 17 - DNA, 49 bp, Artificial Sequence
  Synthetic
tggagttcagacgtgtgctcttccgatctccagccccatctgtcaaact

SEQ ID NO: 18 - DNA, 49 bp, Artificial Sequence
  Synthetic
tggagttcagacgtgtgctcttccgatcttcctttcaacccgaacggag

SEQ ID NO: 19 - DNA, 57 bp, Artificial Sequence
  Synthetic
  misc_feature (34)..(37): n is a, c, g, or t
acactctttccctacacgacgctcttccgatctnnnngctggtcttctttcccctcc

SEQ ID NO: 20 - DNA, 59 bp, Artificial Sequence
  Synthetic
  misc_feature (34)..(37): n is a, c, g, or t
acactctttccctacacgacgctcttccgatctnnnngagttactgctcagacatgtaa

SEQ ID NO: 21 - DNA, 49 bp, Artificial Sequence
  Synthetic
tggagttcagacgtgtgctcttccgatctgacctcgtgatccacctgcc

SEQ ID NO: 22 - DNA, 60 bp, Artificial Sequence
  Synthetic
  misc_feature (34)..(37): n is a, c, g, or t
acactctttccctacacgacgctcttccgatctnnnnatttgatggagttggacatggcc

SEQ ID NO: 23 - DNA, 46 bp, Artificial Sequence
  Synthetic
tggagttcagacgtgtgctctccagctacttgttcttgagtgaagg

SEQ ID NO: 24 - DNA, 59 bp, Artificial Sequence
  Synthetic
  misc_feature (34)..(37): n is a, c, g, or t
acactctttccctacacgacgctcttccgatctnnnntggctttccaaatcagtgggtc

SEQ ID NO: 25 - DNA, 52 bp, Artificial Sequence
  Synthetic
tggagttcagacgtgtgctcttccgatctctcataagcttagaccaacaagc

SEQ ID NO: 26 - DNA, 58 bp, Artificial Sequence
  Synthetic
  misc_feature (34)..(37): n is a, c, g, or t
acactctttccctacacgacgctcttccgatctnnnnctggttgaccaatctgtggtg

SEQ ID NO: 27 - DNA, 41 bp, Artificial Sequence
  Synthetic
tggagttcagacgtgtgctctctgcgtctggatcaggtacg

SEQ ID NO: 28 - DNA, 244 bp, Artificial Sequence
  Synthetic
tggtcttctttcccctcccctgccctcccctcccttcaagatggctgacaaaggccgggctgggtggaaggaagggaggaagggcgaggcagagggtccaaagcaggatgacaggcaggggcaccgcggcgccccggtggcactgcggctggaggtgggggttaaagcggagactctggtgctgtgtgactacagtgggggccctgccctctctgagcccccgcctccaggcctgtgtgtgtgt

SEQ ID NO: 29 - DNA, 232 bp, Artificial Sequence
  Synthetic
ggaaacgcccatgcaattagtctatttctgctgcaagtaagcatgcatttgtaggcttgatgctttttttctgcttctccagccctggcctgggtcaatccttggggcccagactgagcacgtgatggcagaggaaaggaagccctgcttcctccagagggcgtcgcaggacagcttttcctagacaggggctagtatgtgcagctcctgcaccgggatactggttgacaag

SEQ ID NO: 30 - DNA, 200 bp, Artificial Sequence
  Synthetic
tgaatggattccttggaaacaatgataacaagacctggctgagctaactgtgacagcatgtggtaattttccagcccgctggccctgtaaaggaaactggaacacaaagcatagactgcggggcgggccagcctgaatagctgcaaacaagtgcagaatatctgatgatgtcatacgcacagtttgacagatggggctgg

SEQ ID NO: 31 - DNA, 191 bp, Artificial Sequence
  Synthetic
gccctgcttctttttctctggttgtctcttcttgagaaaatcaacacactctgtcctgttttccagctgtggccacctgtcgccctgacgaattccagtgctctgatggaaactgcatccatggcagccggcagtgtgaccgggaatatgactgcaaggacatgagcgatgaagttggctgcgttaatggt

SEQ ID NO: 32 - DNA, 290 bp, Artificial Sequence
  Synthetic
cttctctgtctccacatgcccagtttctattggtctccttaaacctgtcttgtaaccttgataccaacctgcccagggcctcaccaccaacttcatccacgttcaccttgccccacagggcagtaacggcagacttctcctcaggagtcagatgcaccatggtgtctgtttgaggttgctagtgaacacagttgtgtcagaagcaaatgtaagcaatagatggctctgccctgacttttatgcccagccctggctcctgccctccctgctcctgggagtagattggccaa

SEQ ID NO: 33 - DNA, 203 bp, Artificial Sequence
  Synthetic
gttactgctcagacatgtaataataataaataacacatcaaataaccataccattttaagctgtagtattatgaagggaaatctggagcaaagagaatagactgtagggaaaccagttaagaaataggacatggaggctaggtgcagtggctcacgcctgtaatcgcagcactttgggaggctgaggcaggtggatcacgagg

SEQ ID NO: 34 - DNA, 232 bp, Artificial Sequence; identical to SEQ ID NO: 29
  Synthetic

SEQ ID NO: 35 - DNA, 217 bp, Artificial Sequence
  Synthetic
ttggctttccaaatcagtgggtctgacttgaggtctgtgatgtgacccttttcctcacctgctcaaccattattcacatggactccatcatattcatttgtagtcattcccagagtggcccagtgagggtctcgctgtatgagagtcggctacggaatttaggagaaacagaagtttcttggctttcatgctgagcttgttggtctaagcttatgag

SEQ ID NO: 36 - DNA, 224 bp, Artificial Sequence
  Synthetic
tttgatggagttggacatggccatggaaccagacagaaaagcggctgttagtcactggcagcaacagtcttacctggactctggaatccattctggtgccactaccacagctccttctctgagtggtaaaggcaatcctgaggaagaggatgtggatacctcccaagtcctgtatgagtggaacagggattttctcagtccttcactcaagaacaagtagctgg

SEQ ID NO: 37 - DNA, 244 bp, Artificial Sequence
  Synthetic
ctggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtac

SEQ ID NO: 38 - DNA, 58 bp, Artificial Sequence
  Synthetic
  misc_feature (34)..(37): n is a, c, g, or t
acactctttccctacacgacgctcttccgatctnnnngtgtggagagtgagtaagcca

SEQ ID NO: 39 - DNA, 50 bp, Artificial Sequence
  Synthetic
tggagttcagacgtgtgctcttccgatctacggtaggatgatttcaggca

SEQ ID NO: 40 - DNA, 58 bp, Artificial Sequence
  Synthetic
  misc_feature (34)..(37): n is a, c, g, or t
acactctttccctacacgacgctcttccgatctnnnncacaaagcagtgtagctcagg

SEQ ID NO: 41 - DNA, 54 bp, Artificial Sequence
  Synthetic
tggagttcagacgtgtgctcttccgatcttttttggtactcgagtgttattcag

SEQ ID NO: 42 - DNA, 57 bp, Artificial Sequence
  Synthetic
  misc_feature (34)..(37): n is a, c, g, or t
acactctttccctacacgacgctcttccgatctnnnntcccctgttgacctggagaa

SEQ ID NO: 43 - DNA, 49 bp, Artificial Sequence
  Synthetic
tggagttcagacgtgtgctcttccgatctcactgtacttgccctgacca

SEQ ID NO: 44 - DNA, 57 bp, Artificial Sequence
  Synthetic
  misc_feature (34)..(37): n is a, c, g, or t
acactctttccctacacgacgctcttccgatctnnnnttggtgttgacagggagcaa

SEQ ID NO: 45 - DNA, 49 bp, Artificial Sequence
  Synthetic
tggagttcagacgtgtgctcttccgatctctgagatgtgggcagaaggg

SEQ ID NO: 46 - DNA, 57 bp, Artificial Sequence
  Synthetic
  misc_feature (34)..(37): n is a, c, g, or t
acactctttccctacacgacgctcttccgatctnnnntgagagggaacagaagggct

SEQ ID NO: 47 - DNA, 49 bp, Artificial Sequence
  Synthetic
tggagttcagacgtgtgctcttccgatctgtccaaaggcccaagaacct

SEQ ID NO: 48 - DNA, 58 bp, Artificial Sequence
  Synthetic
  misc_feature (34)..(37): n is a, c, g, or t
acactctttccctacacgacgctcttccgatctnnnntcctagcactttggaaggtcg

SEQ ID NO: 49 - DNA, 51 bp, Artificial Sequence
  Synthetic
tggagttcagacgtgtgctcttccgatctgctcatcttaatctgctcagcc

SEQ ID NO: 50 - DNA, 57 bp, Artificial Sequence
  Synthetic
  misc_feature (34)..(37): n is a, c, g, or t
acactctttccctacacgacgctcttccgatctnnnnaaaggagcagctcttcctgg

SEQ ID NO: 51 - DNA, 49 bp, Artificial Sequence
  Synthetic
tggagttcagacgtgtgctcttccgatctgtctgcaccatctcccacaa

SEQ ID NO: 52 - DNA, 57 bp, Artificial Sequence
  Synthetic
  misc_feature (34)..(37): n is a, c, g, or t
acactctttccctacacgacgctcttccgatctnnnnggcatggcttctgagactca

SEQ ID NO: 53 - DNA, 53 bp, Artificial Sequence
  Synthetic
tggagttcagacgtgtgctcttccgatctgtctcccttgcactccctgtcttt

SEQ ID NO: 54 - DNA, 57 bp, Artificial Sequence
  Synthetic
  misc_feature (34)..(37): n is a, c, g, or t
acactctttccctacacgacgctcttccgatctnnnntttggcaatggaggcattgg

SEQ ID NO: 55 - DNA, 49 bp, Artificial Sequence
  Synthetic
tggagttcagacgtgtgctcttccgatctgaagaggctgcccatgagag

SEQ ID NO: 56 - DNA, 57 bp, Artificial Sequence
  Synthetic
  misc_feature (34)..(37): n is a, c, g, or t
acactctttccctacacgacgctcttccgatctnnnnggtctgaggctcgaatcctg

SEQ ID NO: 57 - DNA, 49 bp, Artificial Sequence
  Synthetic
tggagttcagacgtgtgctcttccgatctctgtggcctccatatccctg

SEQ ID NO: 58 - DNA, 57 bp, Artificial Sequence
  Synthetic
  misc_feature (34)..(37): n is a, c, g, or t
acactctttccctacacgacgctcttccgatctnnnntttccaccagaactcagccc

SEQ ID NO: 59 - DNA, 49 bp, Artificial Sequence
  Synthetic
tggagttcagacgtgtgctcttccgatctcctcggttcctccacaacac

SEQ ID NO: 60 - DNA, 57 bp, Artificial Sequence
  Synthetic
  misc_feature (34)..(37): n is a, c, g, or t
acactctttccctacacgacgctcttccgatctnnnncacgggaaggacaggagaag

SEQ ID NO: 61 - DNA, 49 bp, Artificial Sequence
  Synthetic
tggagttcagacgtgtgctcttccgatctgcaggggagggataaagcag

SEQ ID NO: 62 - DNA, 20 bp, Artificial Sequence
  Synthetic
gaacacaatgcatagattgc

SEQ ID NO: 63 - DNA, 265 bp, Artificial Sequence
  Synthetic
gtgtggagagtgagtaagccagaacacaatgcatagattgccggtaaataggtttagattcatccatttttaaaaaatggtgtgggagcattaaatatgtatatagtagatatggaaaaatgattctcataataactgacatttctgtttcacaagaaaattattttacattatatgtatattttacataaattatacatagtcatttaaaaagctcaaatagtgcaaaaacaatatggagaattgcctgaaatcatcctaccgt

SEQ ID NO: 64 - DNA, 20 bp, Artificial Sequence
  Synthetic
aaacataaagcatagactgc

SEQ ID NO: 65 - DNA, 175 bp, Artificial Sequence
  Synthetic
cacaaagcagtgtagctcagggaaggagcagtgagtttgggcacttgtgacagaatagtgggactatgccagagatacacaggaggaggtggtaccttctagctccccctcaaaacataaagcatagactgcaaagtactcccaagcaggctgaataacactcgagtaccaaaaa

SEQ ID NO: 66 - DNA, 20 bp, Artificial Sequence
  Synthetic
cacccagactgagcacgtgc

SEQ ID NO: 67 - DNA, 175 bp, Artificial Sequence
  Synthetic
tcccctgttgacctggagaagcatgaaccagtcaaaaagtttaaagacaagagcattaactgcaccagtgggcagctcagctcagacaccagtagcgtgggcacccagactgagcacgtgctggagcccaagaaatgcagagacctgtgcacctctggtcagggcaagtacagtg

SEQ ID NO: 68 - DNA, 20 bp, Artificial Sequence
  Synthetic
gacacagaccgggcacgtga

SEQ ID NO: 69 - DNA, 175 bp, Artificial Sequence
  Synthetic
ttggtgttgacagggagcaacttcacagtcccaggcatcaggacacagaccgggcacgtgagggaagcccaagggagaggactggtgtaatcgaggctgactccacttttaatgtttgactgatgataggtttcaagtctcactaagtctccttccccttctgcccacatctcag

SEQ ID NO: 70 - DNA, 20 bp, Artificial Sequence
  Synthetic
agctcagactgagcaagtga

SEQ ID NO: 71 - DNA, 175 bp, Artificial Sequence
  Synthetic
tgagagggaacagaagggctaagactaaaaggaacagaggagttcatagtgagcggtaaagagctcagactgagcaagtgaggggctcagcctcccatggaggacagggggctggggcccctggctgatgtctggactgaagcccccacgcccagaggttcttgggcctttggac

SEQ ID NO: 72 - DNA, 20 bp, Artificial Sequence
  Synthetic
agaccagactgagcaagaga

SEQ ID NO: 73 - DNA, 174 bp, Artificial Sequence
  Synthetic
cctagcactttggaaggtcgaagcggcaggatggcttcaacccaggagttcgagaccagactgagcaagagagggagagtgtctgtattaacaacaaacaaacaaacaaaaaactaaactaaaagaaactgtggtgtataatataaaattctggctgagcagattaagatgagc

SEQ ID NO: 74 - DNA, 20 bp, Artificial Sequence
  Synthetic
gagccagaatgagcacgtga

SEQ ID NO: 75 - DNA, 175 bp, Artificial Sequence
  Synthetic
aaaggagcagctcttcctggtggaaattgcgagcagaggctgcgtgagttccgtaactcgcacacagcctccatttggagccagaatgagcacgtgagggaccccgggcagaggggccagtgctgacattatgctccatgcaacctcccatcctgttgtgggagatggtgcagac

SEQ ID NO: 76 - DNA, 20 bp, Artificial Sequence
  Synthetic
tgcactgcggccggaggagg

SEQ ID NO: 77 - DNA, 175 bp, Artificial Sequence
  Synthetic
ggcatggcttctgagactcatagctggggctgaagatccctaggggggctctgctgggctcactgctctccagagtggtccagcccggctgcagggtgctgcttccagcttggtgcactgcggccggaggaggtggaggatggaaagtaagattcaaagacagggagtgcaaggg

SEQ ID NO: 78 - DNA, 20 bp, Artificial Sequence
  Synthetic
ggctctgcggctggaggggg

SEQ ID NO: 79 - DNA, 175 bp, Artificial Sequence
  Synthetic
tttggcaatggaggcattgggcaggggaagcctgtcttcagggcacatgcacgtgcgcagggctctgcggctggagggggtggggttgctgttagtgacaggggccccagccaggcaggtttcaggattggggagcacttgcttcggctcccttgctctcatgggcagcctcttc

SEQ ID NO: 80 - DNA, 20 bp, Artificial Sequence
  Synthetic
ggcacgacggctggaggtgg

SEQ ID NO: 81 - DNA, 175 bp, Artificial Sequence
  Synthetic
ggtctgaggctcgaatcctggcagcaggtccttcatggcaaggcgggaaaagagaaaagccaacgggttctcatgctgggaaaagatgccgggcacgacggctggaggtggggggttgggagtgggtgggatgcttgcgtgccctgcatgaggtgcagggatatggaggccacag

SEQ ID NO: 82 - DNA, 20 bp, Artificial Sequence
  Synthetic
ggcatcacggctggaggtgg

SEQ ID NO: 83 - DNA, 174 bp, Artificial Sequence
  Synthetic
ttccaccagaactcagcccaggctgctgtgggatggaatcacctgcacccggatgttctttctgggctggtacatacaggcaaggcatcacggctggaggtggagggggcctaacccggggttgcccaggaaggggtttgcacatggattcggtgtgttgtggaggaaccgagg

SEQ ID NO: 84 - DNA, 20 bp, Artificial Sequence
  Synthetic
ggcgctgcggcgggaggtgg

SEQ ID NO: 85 - DNA, 175 bp, Artificial Sequence
  Synthetic
cacgggaaggacaggagaaggtgctggaccgcctggactttgtgctgaccagccttgtggcgctgcggcgggaggtggaggagctgagaagcagcctgcgagggcttgcgggggagattgttggggaggtccggtgagtaatgcggcttcttctcctgctttatccctcccctgc

SEQ ID NO: 86 - protein, 167 aa, E. coli
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 87 - protein, 178 aa, E. coli
MRRAFITGVFFLSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 88 - protein, 160 aa, Staphylococcus aureu
MGSHMTNDIYFMTLAIEEAKKAAQLGEVPIGAIITKDDEVIARAHNLRETLQQPTAHAEHIAIERAAKVLGSWRLEGCTLYVTLEPCVMCAGTIVMSRIPRVVYGADDPKGGCSGSLMNLLQQSNFNHRAIVDKGVLKEACSTLLTTFFKNLRANKKSTN

SEQ ID NO: 89 - protein, 161 aa, Bacillus subtilis
MTQDELYMKEAIKEAKKAEEKGEVPIGAVLVINGEIIARAHNLRETEQRSIAHAEMLVIDEACKALGTWRLEGATLYVTLEPCPMCAGAVVLSRVEKVVFGAFDPKGGCSGTLMNLLQEERFNHQAEVVSGVLEEECGGMLSAFFRELRKKKKAARKNLSE

SEQ ID NO: 90 - protein, 183 aa, Salmonella typhimurium
MPPAFITGVTSLSDVELDHEYWMRHALTLAKRAWDEREVPVGAVLVHNHRVIGEGWNRPIGRHDPTAHAEIMALRQGGLVLQNYRLLDTTLYVTLEPCVMCAGAMVHSRIGRVVFGARDAKTGAAGSLIDVLHHPGMNHRVEIIEGVLRDECATLLSDFFRMRRQEIKALKKADRAEGAGPAV

SEQ ID NO: 91 - protein, 164 aa, Shewanella putrefacien
MDEYWMQVAMQMAEKAEAAGEVPVGAVLVKDGQQIATGYNLSISQHDPTAHAEILCLRSAGKKLENYRLLDATLYITLEPCAMCAGAMVHSRIARVVYGARDEKTGAAGTVVNLLQHPAFNHQVEVTSGVLAEACSAQLSRFFKRRRDEKKALKLAQRAQQGIE

SEQ ID NO: 92 - protein, 173 aa, H. influenzae
MDAAKVRSEFDEKMMRYALELADKAEALGEIPVGAVLVDDARNIIGEGWNLSIVQSDPTAHAEIIALRNGAKNIQNYRLLNSTLYVTLEPCTMCAGAILHSRIKRLVFGASDYKTGAIGSRFHFFDDYKMNHTLEITSGVLAEECSQKLSTFFQKRREEKKIEKALLKSLSDK

SEQ ID NO: 93 - protein, 161 aa, Caulobacter crescentus
MRTDESEDQDHRMMRLALDAARAAAEAGETPVGAVILDPSTGEVIATAGNGPIAAHDPTAHAEIAAMRAAAAKLGNYRLTDLTLVVTLEPCAMCAGAISHARIGRVVFGADDPKGGAVVHGPKFFAQPTCHWRPEVTGGVLADESADLLRGFFRARRKAKI

SEQ ID NO: 94 - protein, 179 aa, Geobacter sulfurreducen
MSSLKKTPIRDDAYWMGKAIREAAKAAARDEVPIGAVIVRDGAVIGRGHNLREGSNDPSAHAEMIAIRQAARRSANWRLTGATLYVTLEPCLMCMGAIILARLERVVFGCYDPKGGAAGSLYDLSADPRLNHQVRLSPGVCQEECGTMLSDFFRDLRRRKKAKATPALFIDERKVPPEP

SEQ ID NO: 95 - protein, 167 aa, E. coli
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 96 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 97 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNAKTGAAGSLMDVLHYPGMNHRVEITEGILADECAALLCYFFRMPRQVFNAQKKAQSSTD

SEQ ID NO: 98 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRWAKTGAAGSLMDVLHYPGMNHRVEITEGILADECAALLCYFFRMPRQVFNAQKKAQSSTD

SEQ ID NO: 99 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRQAKTGAAGSLMDVLHYPGMNHRVEITEGILADECAALLCYFFRMPRQVFNAQKKAQSSTD

SEQ ID NO: 100 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGFRNAKTGAAGSLMDVLHYPGMNHRVEITEGILADECAALLCYFFRMPRQVFNAQKKAQSSTD

SEQ ID NO: 101 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGQRNAKTGAAGSLMDVLHYPGMNHRVEITEGILADECAALLCYFFRMPRQVFNAQKKAQSSTD

SEQ ID NO: 102 - protein, 167 aa, E. coli
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGMRNAKTGAAGSLMDVLHYPGMNHRVEITEGILADECAALLCYFFRMPRQVFNAQKKAQSSTD

SEQ ID NO: 103 - protein, 167 aa, E. coli
MSEVEFSHEYWMRHALTLAKRARDEREVPVGAVLVLNNRVIGEGWNFAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 104 - protein, 167 aa, E. coli
MSEVEFSHEYWMRHALTLAKRARDEREVPVGAVLVLNNRVIGEGWNWAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 105 - protein, 167 aa, E. coli
MSEVEFSHEYWMRHALTLAKRARDEREVPVGAVLVLNNRVIGEGWNQAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 106 - protein, 167 aa, E. coli
MSEVEFSHEYWMRHALTLAKRARDEREVPVGAVLVLNNRVIGEGWNMAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 107 - protein, 167 aa, E. coli
MSEVEFSHEYWMRHALTLAKRAWDEREVPVGAVLVHNNRVIGEGWNRPIGRHDPTAHAQIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 108 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 109 - protein, 1368 aa, Streptococcus pyogenes
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 110 - protein, 171 aa, Streptococcus pyogenes
MPYSLEEQTYFMQEALKEAEKSLQKAEIPIGCVIVKDGEIIGRGHNAREESNQAIMHAEIMAINEANAHEGNWRLLDTTLFVTIEPCVMCSGAIGLARIPHVIYGASNQKFGGADSLYQILTDERLNHRVQVERGLLAADCANIMQTFFRQGRERKKIAKHLIKEQSDPFD

SEQ ID NO: 111 - protein, 16 aa, Artificial Sequence
  Synthetic
SGSETPGTSESATPES

SEQ ID NO: 112 - protein, 32 aa, Artificial Sequence
  Synthetic
SGGSSGGSSGSETPGTSESATPESSGGSSGGS

SEQ ID NO: 113 - protein, 4 aa, Artificial Sequence
  Synthetic
SGGS

SEQ ID NO: 114 - protein, 18 aa, Artificial Sequence
  Synthetic
KRTADGSEFESPKKKRKV

SEQ ID NO: 115 - protein, 17 aa, Artificial Sequence
  Synthetic
KRTADGSEFEPKKKRKV

SEQ ID NO: 116 - protein, 6 aa, Artificial Sequence
  Synthetic
NNNRRT

SEQ ID NO: 117 - protein, 7 aa, Artificial Sequence
  Synthetic
PKKKRKV

SEQ ID NO: 118 - protein, 30 aa, Artificial Sequence
  Synthetic
MDSLLMNRRKFLYQFKNVRWAKGRRETYLC

SEQ ID NO: 119 - DNA, 4104 bp, Streptococcus pyogenes
atggataaaaaatatagcattggcctggatattggcaccaacagcgtgggctgggcggtgattaccgatgaatataaagtgccgagcaaaaaatttaaagtgctgggcaacaccgatcgccatagcattaaaaaaaacctgattggcgcgctgctgtttgatagcggcgaaaccgcggaagcgacccgcctgaaacgcaccgcgcgccgccgctatacccgccgcaaaaaccgcatttgctatctgcaggaaatttttagcaacgaaatggcgaaagtggatgatagcttttttcatcgcctggaagaaagctttctggtggaagaagataaaaaacatgaacgccatccgatttttggcaacattgtggatgaagtggcgtatcatgaaaaatatccgaccatttatcatctgcgcaaaaaactggtggatagcaccgataaagcggatctgcgcctgatttatctggcgctggcgcatatgattaaatttcgcggccattttctgattgaaggcgatctgaacccggataacagcgatgtggataaactgtttattcagctggtgcagacctataaccagctgtttgaagaaaacccgattaacgcgagcggcgtggatgcgaaagcgattctgagcgcgcgcctgagcaaaagccgccgcctggaaaacctgattgcgcagctgccgggcgaaaaaaaaaacggcctgtttggcaacctgattgcgctgagcctgggcctgaccccgaactttaaaagcaactttgatctggcggaagatgcgaaactgcagctgagcaaagatacctatgatgatgatctggataacctgctggcgcagattggcgatcagtatgcggatctgtttctggcggcgaaaaacctgagcgatgcgattctgctgagcgatattctgcgcgtgaacaccgaaattaccaaagcgccgctgagcgcgagcatgattaaacgctatgatgaacatcatcaggatctgaccctgctgaaagcgctggtgcgccagcagctgccggaaaaatataaagaaattttttttgatcagagcaaaaacggctatgcgggctatattgatggcggcgcgagccaggaagaattttataaatttattaaaccgattctggaaaaaatggatggcaccgaagaactgctggtgaaactgaaccgcgaagatctgctgcgcaaacagcgcacctttgataacggcagcattccgcatcagattcatctgggcgaactgcatgcgattctgcgccgccaggaagatttttatccgtttctgaaagataaccgcgaaaaaattgaaaaaattctgacctttcgcattccgtattatgtgggcccgctggcgcgcggcaacagccgctttgcgtggatgacccgcaaaagcgaagaaaccattaccccgtggaactttgaagaagtggtggataaaggcgcgagcgcgcagagctttattgaacgcatgaccaactttgataaaaacctgccgaacgaaaaagtgctgccgaaacatagcctgctgtatgaatattttaccgtgtataacgaactgaccaaagtgaaatatgtgaccgaaggcatgcgcaaaccggcgtttctgagcggcgaacagaaaaaagcgattgtggatctgctgtttaaaaccaaccgcaaagtgaccgtgaaacagctgaaagaagattattttaaaaaaattgaatgctttgatagcgtggaaattagcggcgtggaagatcgctttaacgcgagcctgggcacctatcatgatctgctgaaaattattaaagataaagattttctggataacgaagaaaacgaagatattctggaagatattgtgctgaccctgaccctgtttgaagatcgcgaaatgattgaagaacgcctgaaaacctatgcgcatctgtttgatgataaagtgatgaaacagctgaaacgccgccgctataccggctggggccgcctgagccgcaaactgattaacggcattcgcgataaacagagcggcaaaaccattctggattttctgaaaagcgatggctttgcgaaccgcaactttatgcagctgattcatgatgatagcctgacctttaaagaagatattcagaaagcgcaggtgagcggccagggcgatagcctgcatgaacatattgcgaacctggcgggcagcccggcgattaaaaaaggcattctgcagaccgtgaaagtggtggatgaactggtgaaagtgatgggccgccataaaccggaaaacattgtgattgaaatggcgcgcgaaaaccagaccacccagaaaggccagaaaaacagccgcgaacgcatgaaacgcattgaagaaggcattaaagaactgggcagccagattctgaaagaacatccggtggaaaacacccagctgcagaacgaaaaactgtatctgtattatctgcagaacggccgcgatatgtatgtggatcaggaactggatattaaccgcctgagcgattatgatgtggatcatattgtgccgcagagctttctgaaagatgatagcattgataacaaagtgctgacccgcagcgataaaaaccgcggcaaaagcgataacgtgccgagcgaagaagtggtgaaaaaaatgaaaaactattggcgccagctgctgaacgcgaaactgattacccagcgcaaatttgataacctgaccaaagcggaacgcggcggcctgagcgaactggataaagcgggctttattaaacgccagctggtggaaacccgccagattaccaaacatgtggcgcagattctggatagccgcatgaacaccaaatatgatgaaaacgataaactgattcgcgaagtgaaagtgattaccctgaaaagcaaactggtgagcgattttcgcaaagattttcagttttataaagtgcgcgaaattaacaactatcatcatgcgcatgatgcgtatctgaacgcggtggtgggcaccgcgctgattaaaaaatatccgaaactggaaagcgaatttgtgtatggcgattataaagtgtatgatgtgcgcaaaatgattgcgaaaagcgaacaggaaattggcaaagcgaccgcgaaatattttttttatagcaacattatgaacttttttaaaaccgaaattaccctggcgaacggcgaaattcgcaaacgcccgctgattgaaaccaacggcgaaaccggcgaaattgtgtgggataaaggccgcgattttgcgaccgtgcgcaaagtgctgagcatgccgcaggtgaacattgtgaaaaaaaccgaagtgcagaccggcggctttagcaaagaaagcattctgccgaaacgcaacagcgataaactgattgcgcgcaaaaaagattgggatccgaaaaaatatggcggctttgatagcccgaccgtggcgtatagcgtgctggtggtggcgaaagtggaaaaaggcaaaagcaaaaaactgaaaagcgtgaaagaactgctgggcattaccattatggaacgcagcagctttgaaaaaaacccgattgattttctggaagcgaaaggctataaagaagtgaaaaaagatctgattattaaactgccgaaatatagcctgtttgaactggaaaacggccgcaaacgcatgctggcgagcgcgggcgaactgcagaaaggcaacgaactggcgctgccgagcaaatatgtgaactttctgtatctggcgagccattatgaaaaactgaaaggcagcccggaagataacgaacagaaacagctgtttgtggaacagcataaacattatctggatgaaattattgaacagattagcgaatttagcaaacgcgtgattctggcggatgcgaacctggataaagtgctgagcgcgtataacaaacatcgcgataaaccgattcgcgaacaggcggaaaacattattcatctgtttaccctgaccaacctgggcgcgccggcggcgtttaaatattttgataccaccattgatcgcaaacgctataccagcaccaaagaagtgctggatgcgaccctgattcatcagagcattaccggcctgtatgaaacccgcattgatctgagccagctgggcggcgat

SEQ ID NO: 120 - DNA, 4104 bp, Streptococcus pyogenes
atggataagaaatactcaataggcttagatatcggcacaaatagcgtcggatgggcggtgatcactgatgattataaggttccgtctaaaaagttcaaggttctgggaaatacagaccgccacagtatcaaaaaaaatcttataggggctcttttatttggcagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggcagattctactgataaagcggatttgcgcttaatctatttggccttagcgcatatgattaagtttcgtggtcattttttgattgagggagatttaaatcctgataatagtgatgtggacaaactatttatccagttggtacaaatctacaatcaattatttgaagaaaaccctattaacgcaagtagagtagatgctaaagcgattctttctgcacgattgagtaaatcaagacgattagaaaatctcattgctcagctccccggtgagaagagaaatggcttgtttgggaatctcattgctttgtcattgggattgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatagtgaaataactaaggctcccctatcagcttcaatgattaagcgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgagggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggcgcctaccatgatttgctaaaaattattaaagataaagattttttggataatgaagaaaatgaagatatcttagaggatattgttttaacattgaccttatttgaagatagggggatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagatattcaaaaagcacaggtgtctggacaaggccatagtttacatgaacagattgctaacttagctggcagtcctgctattaaaaaaggtattttacagactgtaaaaattgttgatgaactggtcaaagtaatggggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctacaaaatggaagagacatgtatgtggaccaagaattagatattaatcgtttaagtgattatgatgtcgatcacattgttccacaaagtttcattaaagacgattcaatagacaataaggtactaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 121 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 122 - DNA, 4212 bp, Streptococcus pyogenes
atggataaaaagtattctattggtttagacatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatcacattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctcgagcgactacaaagaccatgacggtgattataaagatcatgacatcgattacaaggatgacgatgacaaggctgcagga

SEQ ID NO: 123 - protein, 1404 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSSDYKDHDGDYKDHDIDYKDDDDKAAG

SEQ ID NO: 124 - DNA, 4107 bp, Streptococcus pyogenes
atggataagaaatactcaataggcttagatatcggcacaaatagcgtcggatgggcggtgatcactgatgaatataaggttccgtctaaaaagttcaaggttctgggaaatacagaccgccacagtatcaaaaaaaatcttataggggctcttttatttgacagtggagagacagcggaagcgactcgtctcaaacggacagctcgtagaaggtatacacgtcggaagaatcgtatttgttatctacaggagattttttcaaatgagatggcgaaagtagatgatagtttctttcatcgacttgaagagtcttttttggtggaagaagacaagaagcatgaacgtcatcctatttttggaaatatagtagatgaagttgcttatcatgagaaatatccaactatctatcatctgcgaaaaaaattggtagattctactgataaagcggatttgcgcttaatctatttggccttagcgcatatgattaagtttcgtggtcattttttgattgagggagatttaaatcctgataatagtgatgtggacaaactatttatccagttggtacaaacctacaatcaattatttgaagaaaaccctattaacgcaagtggagtagatgctaaagcgattctttctgcacgattgagtaaatcaagacgattagaaaatctcattgctcagctccccggtgagaagaaaaatggcttatttgggaatctcattgctttgtcattgggtttgacccctaattttaaatcaaattttgatttggcagaagatgctaaattacagctttcaaaagatacttacgatgatgatttagataatttattggcgcaaattggagatcaatatgctgatttgtttttggcagctaagaatttatcagatgctattttactttcagatatcctaagagtaaatactgaaataactaaggctcccctatcagcttcaatgattaaacgctacgatgaacatcatcaagacttgactcttttaaaagctttagttcgacaacaacttccagaaaagtataaagaaatcttttttgatcaatcaaaaaacggatatgcaggttatattgatgggggagctagccaagaagaattttataaatttatcaaaccaattttagaaaaaatggatggtactgaggaattattggtgaaactaaatcgtgaagatttgctgcgcaagcaacggacctttgacaacggctctattccccatcaaattcacttgggtgagctgcatgctattttgagaagacaagaagacttttatccatttttaaaagacaatcgtgagaagattgaaaaaatcttgacttttcgaattccttattatgttggtccattggcgcgtggcaatagtcgttttgcatggatgactcggaagtctgaagaaacaattaccccatggaattttgaagaagttgtcgataaaggtgcttcagctcaatcatttattgaacgcatgacaaactttgataaaaatcttccaaatgaaaaagtactaccaaaacatagtttgctttatgagtattttacggtttataacgaattgacaaaggtcaaatatgttactgaaggaatgcgaaaaccagcatttctttcaggtgaacagaagaaagccattgttgatttactcttcaaaacaaatcgaaaagtaaccgttaagcaattaaaagaagattatttcaaaaaaatagaatgttttgatagtgttgaaatttcaggagttgaagatagatttaatgcttcattaggtacctaccatgatttgctaaaaattattaaagataaagattttttggataatgaagaaaatgaagatatcttagaggatattgttttaacattgaccttatttgaagatagggagatgattgaggaaagacttaaaacatatgctcacctctttgatgataaggtgatgaaacagcttaaacgtcgccgttatactggttggggacgtttgtctcgaaaattgattaatggtattagggataagcaatctggcaaaacaatattagattttttgaaatcagatggttttgccaatcgcaattttatgcagctgatccatgatgatagtttgacatttaaagaagacattcaaaaagcacaagtgtctggacaaggcgatagtttacatgaacatattgcaaatttagctggtagccctgctattaaaaaaggtattttacagactgtaaaagttgttgatgaattggtcaaagtaatggggcggcataagccagaaaatatcgttattgaaatggcacgtgaaaatcagacaactcaaaagggccagaaaaattcgcgagagcgtatgaaacgaatcgaagaaggtatcaaagaattaggaagtcagattcttaaagagcatcctgttgaaaatactcaattgcaaaatgaaaagctctatctctattatctccaaaatggaagagacatgtatgtggaccaagaattagatattaatcgtttaagtgattatgatgtcgatcacattgttccacaaagtttccttaaagacgattcaatagacaataaggtcttaacgcgttctgataaaaatcgtggtaaatcggataacgttccaagtgaagaagtagtcaaaaagatgaaaaactattggagacaacttctaaacgccaagttaatcactcaacgtaagtttgataatttaacgaaagctgaacgtggaggtttgagtgaacttgataaagctggttttatcaaacgccaattggttgaaactcgccaaatcactaagcatgtggcacaaattttggatagtcgcatgaatactaaatacgatgaaaatgataaacttattcgagaggttaaagtgattaccttaaaatctaaattagtttctgacttccgaaaagatttccaattctataaagtacgtgagattaacaattaccatcatgcccatgatgcgtatctaaatgccgtcgttggaactgctttgattaagaaatatccaaaacttgaatcggagtttgtctatggtgattataaagtttatgatgttcgtaaaatgattgctaagtctgagcaagaaataggcaaagcaaccgcaaaatatttcttttactctaatatcatgaacttcttcaaaacagaaattacacttgcaaatggagagattcgcaaacgccctctaatcgaaactaatggggaaactggagaaattgtctgggataaagggcgagattttgccacagtgcgcaaagtattgtccatgccccaagtcaatattgtcaagaaaacagaagtacagacaggcggattctccaaggagtcaattttaccaaaaagaaattcggacaagcttattgctcgtaaaaaagactgggatccaaaaaaatatggtggttttgatagtccaacggtagcttattcagtcctagtggttgctaaggtggaaaaagggaaatcgaagaagttaaaatccgttaaagagttactagggatcacaattatggaaagaagttcctttgaaaaaaatccgattgactttttagaagctaaaggatataaggaagttaaaaaagacttaatcattaaactacctaaatatagtctttttgagttagaaaacggtcgtaaacggatgctggctagtgccggagaattacaaaaaggaaatgagctggctctgccaagcaaatatgtgaattttttatatttagctagtcattatgaaaagttgaagggtagtccagaagataacgaacaaaaacaattgtttgtggagcagcataagcattatttagatgagattattgagcaaatcagtgaattttctaagcgtgttattttagcagatgccaatttagataaagttcttagtgcatataacaaacatagagacaaaccaatacgtgaacaagcagaaaatattattcatttatttacgttgacgaatcttggagctcccgctgcttttaaatattttgatacaacaattgatcgtaaacgatatacgtctacaaaagaagttttagatgccactcttatccatcaatccatcactggtctttatgaaacacgcattgatttgagtcagctaggaggtgactga

SEQ ID NO: 125 - protein, 1368 aa, Streptococcus pyogenes [sequence omitted]

SEQ ID NO: 126 - protein, 1378 aa, Lactobacillus fermentum
MKEYHIGLDIGTSSIGWAVTDSQFKLMRIKGKTAIGVRLFEEGKTAAERRTFRTTRRRLKRRKWRLHYLDEIFAPHLQEVDENFLRRLKQSNIHPEDPTKNQAFIGKLLFPDLLKKNERGYPTLIKMRDELPVEQRAHYPVMNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKASDVASLVMAKTRGVNKPSVEGLSDPKKFNSNLATYLDLKSIVGDKVDDNRYQTDLENIIEWRSVFEDGEIFADKLTEVEWLTDEQRSALVKKRYKGWGRLSKKLLTGIVDENGQRIIDLMWNTDQNFKEIVDQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDNSLDNRVLTSRKENNKKSDQVPAKLYAAKMKPYWNQLLKQGLITQRKFENLTKDVDQNIKYRSLGFVKRQLVETRQVIKLTANILGSMYQEAGTEIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRLVDLYGAYTNGTSAFMTIIKFTGNKPKYKVIGIPTTSAASLKRAGKPGSESYNQELHRIIKSNPKVKKGFEIVVPHVSYGQLIVDGDCKFTLASPTVQHPATQLVLSKKSLETISSGYKILKDKPAIANERLIRVFDEVVGQMNRYFTIFDQRSNRQKVADARDKFLSLPTESKYEGAKKVQVGKTEVITNLLMGLHANATQGDLKVLGLATFGFFQSTTGLSLSEDTMIVYQSPTGLFERRICLKDI

SEQ ID NO: 127 - protein, 1362 aa, Staphylococcus aureus
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 128 - protein, 1053 aa, Staphylococcus aureus
MGKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKK

SEQ ID NO: 129 - protein, 1409 aa, Streptococcus thermophilus
MLFNKCIIISINLDFSNKEKCMTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 130 - protein, 1402 aa, Lactobacillus crispatus
MKIKNYNLALTPSTSAVGHVEVDDDLNILEPVHHQKAIGVAKFGEGETAEARRLARSARRTTKRRANRINHYFNEIMKPEIDKVDPLMFDRIKQAGLSPLDERKEFRTVIFDRPNIASYYHNQFPTIWHLQKYLMITDEKADIRLIYWALHSLLKHRGHFFNTTPMSQFKPGKLNLKDDMLALDDYNDLEGLSFAVANSPEIEKVIKDRSMHKKEKIAELKKLIVNDVPDKDLAKRNNKIITQIVNAIMGNSFHLNFIFDMDLDKLTSKAWSFKLDDPELDTKFDAISGSMTDNQIGIFETLQKIYSAISLLDILNGSSNVVDAKNALYDKHKRDLNLYFKFLNTLPDEIAKTLKAGYTLYIGNRKKDLLAARKLLKVNVAKNFSQDDFYKLINKELKSIDKQGLQTRFSEKVGELVAQNNFLPVQRSSDNVFIPYQLNAITFNKILENQGKYYDFLVKPNPAKKDRKNAPYELSQLMQFTIPYYVGPLVTPEEQVKSGIPKTSRFAWMVRKDNGAITPWNFYDKVDIEATADKFIKRSIAKDSYLLSELVLPKHSLLYEKYEVFNELSNVSLDGKKLSGGVKQILFNEVFKKTNKVNTSRILKALAKHNIPGSKITGLSNPEEFTSSLQTYNAWKKYFPNQIDNFAYQQDLEKMIEWSTVFEDHKILAKKLDEIEWLDDDQKKFVANTRLRGWGRLSKRLLTGLKDNYGKSIMQRLETTKANFQQIVYKPEFREQIDKISQAAAKNQSLEDILANSYTSPSNRKAIRKTMSVVDEYIKLNHGKEPDKIFLMFQRSEQEKGKQTEARSKQLNRILSQLKADKSANKLFSKQLADEFSNAIKKSKYKLNDKQYFYFQQLGRDALTGEVIDYDELYKYTVLHIIPRSKLTDDSQNNKVLTKYKIVDGSVALKFGNSYSDALGMPIKAFWTELNRLKLIPKGKLLNLTTDFSTLNKYQRDGYIARQLVETQQIVKLLATIMQSRFKHTKIIEVRNSQVANIRYQFDYFRIKNLNEYYRGFDAYLAAVVGTYLYKVYPKARRLFVYGQYLKPKKTNQENQDMHLDSEKKSQGFNFLWNLLYGKQDQIFVNGTDVIAFNRKDLITKMNTVYNYKSQKISLAIDYHNGAMFKATLFPRNDRDTAKTRKLIPKKKDYDTDIYGGYTSNVDGYMLLAEIIKRDGNKQYGFYGVPSRLVSELDTLKKTRYTEYEEKLKEIIKPELGVDLKKIKKIKILKNKVPFNQVIIDKGSKFFITSTSYRWNYRQLILSAESQQTLMDLVVDPDFSNHKARKDARKNADERLIKVYEEILYQVKNYMPMFVELHRCYEKLVDAQKTFKSLKISDKAMVLNQILILLHSNATSPVLEKLGYHTRFTLGKKHNLISENAVLVTQSITGLKENHVSIKQML

SEQ ID NO: 131 - protein, 1385 aa, Pedicoccus damnosus
MTNEKYSIGLDIGTSSIGFAVVNDNNRVIRVKGKNAIGVRLFDEGKAAADRRSFRTTRRSFRTTRRRLSRRRWRLKLLREIFDAYITPVDEAFFIRLKESNLSPKDSKKQYSGDILFNDRSDKDFYEKYPTIYHLRNALMTEHRKFDVREIYLAIHHIMKFRGHFLNATPANNFKVGRLNLEEKFEELNDIYQRVFPDESIEFRTDNLEQIKEVLLDNKRSRADRQRTLVSDIYQSSEDKDIEKRNKAVATEILKASLGNKAKLNVITNVEVDKEAAKEWSITFDSESIDDDLAKIEGQMTDDGHEIIEVLRSLYSGITLSAIVPENHTLSQSMVAKYDLHKDHLKLFKKLINGMTDTKKAKNLRAAYDGYIDGVKGKVLPQEDFYKQVQVNLDDSAEANEIQTYIDQDIFMPKQRTKANGSIPHQLQQQELDQIIENQKAYYPWLAELNPNPDKKRQQLAKYKLDELVTFRVPYYVGPMITAKDQKNQSGAEFAWMIRKEPGNITPWNFDQKVDRMATANQFIKRMTTTDTYLLGEDVLPAQSLLYQKFEVLNELNKIRIDHKPISIEQKQQIFNDLFKQFKNVTIKHLQDYLVSQGQYSKRPLIEGLADEKRFNSSLSTYSDLCGIFGAKLVEENDRQEDLEKIIEWSTIFEDKKIYRAKLNDLTWLTDDQKEKLATKRYQGWGRLSRKLLVGLKNSEHRNIMDILWITNENFMQIQAEPDFAKLVTDANKGMLEKTDSQDVINDLYTSPQNKKAIRQILLVVHDIQNAMHGQAPAKIHVEFARGEERNPRRSVQRQRQVEAAYEKVSNELVSAKVRQEFKEAINNKRDFKDRLFLYFMQGGIDIYTGKQLNIDQLSSYQIDHILPQAFVKDDSLTNRVLTNENQVKADSVPIDIFGKKMLSVWGRMKDQGLISKGKYRNLTMNPENISAHTENGFINRQLVETRQVIKLAVNILADEYGDSTQIISVKADLSHQMREDFELLKNRDVNDYHHAFDAYLAAFIGNYLLKRYPKLESYFVYGDFKKFTQKETKMRRFNFIYDLKHCDQVVNKETGEILWTKDEDIKYIRHLFAYKKILVSHEVREKRGALYNQTIYKAKDDKGSGQESKKLIRIKDDKETKIYGGYSGKSLAYMTIVQITKKNKVSYRVIGIPTLALARLNKLENDSTENNGELYKIIKPQFTHYKVDKKNGEIIETTDDFKIVVSKVRFQQLIDDAGQFFMLASDTYKNNAQQLVISNNALKAINNTNITDCPRDDLERLDNLRLDSAFDEIVKKMDKYFSAYDANNFREKIRNSNLIFYQLPVEDQWENNKITELGKRTVLTRILQGLHANATTTDMSIFKIKTPFGQLRQRSGISLSENAQLIYQSPTGLFERRVQLNKIK

SEQ ID NO: 132 - protein, 1367 aa, Fusobacterium nucleatum
MKKQKFSDYYLGFDIGTNSVGWCVTDLDYNVLRFNKKDMWGSRLFEEAKTAAERRVQRNSRRRLKRRKWRLNLLEEIFSNEILKIDSNFFRRLKESSLWLEDKSSKEKFTLFNDDNYKDYDFYKQYPTIFHLRNELIKNPEKKDIRLVYLAIHSIFKSRGHFLFEGQNLKEIKNFETLYNNLIAFLEDNGINKIIDKNNIEKLEKIVCDSKKGLKDKEKEFKEIFNSDKQLVAIFKLSVGSSVSLNDLFDTDEYKKGEVEKEKISFREQIYEDDKPIYYSILGEKIELLDIAKTFYDFMVLNNILADSQYISEAKVKLYEEHKKDLKNLKYIIRKYNKGNYDKLFKDKNENNYSAYIGLNKEKSKKEVIEKSRLKIDDLIKNIKGYLPKVEEIEEKDKAIFNKILNKIELKTILPKQRISDNGTLPYQIHEAELEKILENQSKYYDFLNYEENGIITKDKLLMTFKFRIPYYVGPLNSYHKDKGGNSWIVRKEEGKILPWNFEQKVDIEKSAEEFIKRMTNKCTYLNGEDVIPKDTFLYSEYVILNELNKVQVNDEFLNEENKRKIIDELFKENKKVSEKKFKEYLLVKQIVDGTIELKGVKDSFNSNYISYIRFKDIFGEKLNLDIYKEISEKSILWKCLYGDDKKIFEKKIKNEYGDILTKDEIKKINTFKFNNWGRLSEKLLTGIEFINLETGECYSSVMDALRRTNYNLMELLSSKFTLQESINNENKEMNEASYRDLIEESYVSPSLKRAIFQTLKIYEEIRKITGRVPKKVFIEMARGGDESMKNKKIPARQEQLKKLYDSCGNDIANFSIDIKEMKNSLISYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEKKGQLFDLNPIKKGETSNEIISIKPKVYNGKDDKLNEKYGYYKSLNPAYFLYVEHKEKNKRIKSFERVNLVDVNNIKDEKSLVKYLIENKKLVEPRVIKKVYKRQVILINDYPYSIVTLDSNKLMDFENLKPLFLENKYEKILKNVIKFLEDNQGKSEENYKFIYLKKKDRYEKNETLESVKDRYNLEFNEMYDKFLEKLDSKDYKNYMNNKKYQELLDVKEKFIKLNLFDKAFTLKSFLDLFNRKTMADFSKVGLTKYLGKIQKISSNVLSKNELYLLEESVTGLFVKKIKL

SEQ ID NO: 133 - protein, 1286 aa, Enterococcus cecorum
RRKQRIQILQELLGEEVLKTDPGFFHRMKESRYVVEDKRTLDGKQVELPYALFVDKDYTDKEYYKQFPTINHLIVYLMTTSDTPDIRLVYLALHYYMKNRGNFLHSGDINNVKDINDILEQLDNVLETFLDGWNLKLKSYVEDIKNIYNRDLGRGERKKAFVNTLGAKTKAEKAFCSLISGGSTNLAELFDDSSLKEIETPKIEFASSSLEDKIDGIQEALEDRFAVIEAAKRLYDWKTLTDILGDSSSLAEARVNSYQMHHEQLLELKSLVKEYLDRKVFQEVFVSLNVANNYPAYIGHTKINGKKKELEVKRTKRNDFYSYVKKQVIEPIKKKVSDEAVLTKLSEIESLIEVDKYLPLQVNSDNGVIPYQVKLNELTRIFDNLENRIPVLRENRDKIIKTFKFRIPYYVGSLNGVVKNGKCTNWMVRKEEGKIYPWNFEDKVDLEASAEQFIRRMTNKCTYLVNEDVLPKYSLLYSKYLVLSELNNLRIDGRPLDVKIKQDIYENVFKKNRKVTLKKIKKYLLKEGIITDDDELSGLADDVKSSLTAYRDFKEKLGHLDLSEAQMENIILNITLFGDDKKLLKKRLAALYPFIDDKSLNRIATLNYRDWGRLSERFLSGITSVDQETGELRTIIQCMYETQANLMQLLAEPYHFVEAIEKENPKVDLESISYRIVNDLYVSPAVKRQIWQTLLVIKDIKQVMKHDPERIFIEMAREKQESKKTKSRKQVLSEVYKKAKEYEHLFEKLNSLTEEQLRSKKIYLYFTQLGKCMYSGEPIDFENLVSANSNYDIDHIYPQSKTIDDSFNNIVLVKKSLNAYKSNHYPIDKNIRDNEKVKTLWNTLVSKGLITKEKYERLIRSTPFSDEELAGFIARQLVETRQSTKAVAEILSNWFPESEIVYSKAKNVSNFRQDFEILKVRELNDCHHAHDAYLNIVVGNAYHTKFTNSPYRFIKNKANQEYNLRKLLQKVNKIESNGVVAWVGQSENNPGTIATVKKVIRRNTVLISRMVKEVDGQLFDLTLMKKGKGQVPIKSSDERLTDISKYGGYNKATGAYFTFVKSKKRGKVVRSFEYVPLHLSKQFENNNELLKEYIEKDRGLTDVEILIPKVLINSLFRYNGSLVRITGRGDTRLLLVHEQPLYVSNSFVQQLKSVSSYKLKKSENDNAKLTKTATEKLSNIDELYDGLLRKLDLPIYSYWFSSIKEYLVESRTKYIKLSIEEKALVIFEILHLFQSDAQVPNLKILGLSTKPSRIRIQKNLKDTDKMSIIHQSPSGIFEHEIELTSL

SEQ ID NO: 134 - protein, 1312 aa, Anaerostipes hadrus
MQNGFLGITVSSEQVGWAVTNPKYELERASRKDLWGVRLFDKAETAEDRRMFRTNRRLNQRKKNRIHYLRDIFHEEVNQKDPNFFQQLDESNFCEDDRTVEFNFDTNLYKNQFPTVYHLRKYLMETKDKPDIRLVYLAFSKFMKNRGHFLYKGNLGEVMDFENSMKGFCESLEKFNIDFPTLSDEQVKEVRDILCDHKIAKTVKKKNIITITKVKSKTAKAWIGLFCGCSVPVKVLFQDIDEEIVTDPEKISFEDASYDDYIANIEKGVGIYYEAIVSAKMLFDWSILNEILGDHQLLSDAMIAEYNKHHDDLKRLQKIIKGTGSRELYQDIFINDVSGNYVCYVGHAKTMSSADQKQFYTFLKNRLKNVNGISSEDAEWIDTEIKNGTLLPKQTKRDNSVIPHQLQLREFELILDNMQEMYPFLKENREKLLKIFNFVIPYYVGPLKGVVRKGESTNWMVPKKDGVIHPWNFDEMVDKEASAECFISRMTGNCSYLFNEKVLPKNSLLYETFEVLNELNPLKINGEPISVELKQRIYEQLFLTGKKVTKKSLTKYLIKNGYDKDIELSGIDNEFHSNLKSHIDFEDYDNLSDEEVEQIILRITVFEDKQLLKDYLNREFVKLSEDERKQICSLSYKGWGNLSEMLLNGITVTDSNGVEVSVMDMLWNTNLNLMQILSKKYGYKAEIEHYNKEHEKTIYNREDLMDYLNIPPAQRRKVNQLITIVKSLKKTYGVPNKIFFKISREHQDDPKRTSSRKEQLKYLYKSLKSEDEKHLMKELDELNDHELSNDKVYLYFLQKGRCIYSGKKLNLSRLRKSNYQNDIDYIYPLSAVNDRSMNNKVLTGIQENRADKYTYFPVDSEIQKKMKGFWMELVLQGFMTKEKYFRLSRENDFSKSELVSFIEREISDNQQSGRMIASVLQYYFPESKIVFVKEKLISSFKRDFHLISSYGHNHLQAAKDAYITIVVGNVYHTKFTMDPAIYFKNHKRKDYDLNRLFLENISRDGQIAWESGPYGSIQTVRKEYAQNHIAVTKRVVEVKGGLFKQMPLKKGHGEYPLKTNDPRFGNIAQYGGYTNVTGSYFVLVESMEKGKKRISLEYVPVYLHERLEDDPGHKLLKEYLVDHRKLNHPKILLAKVRKNSLLKIDGFYYRLNGRSGNALILTNAVELIMDDWQTKTANKISGYMKRRAIDKKARVYQNEFHIQELEQLYDFYLDKLKNGVYKNRKNNQAELIHNEKEQFMELKTEDQCVLLTEIKKLFVCSPMQADLTLIGGSKHTGMIAMSSNVTKADFAVIAEDPLGLRNKVIYSHKGEK

SEQ ID NO: 135 - protein, 1344 aa, Kandleria vitulina
MSQNNNKIYNIGLDIGDASVGWAVVDEHYNLLKRHGKHMWGSRLFTQANTAVERRSSRSTRRRYNKRRERIRLLREIMEDMVLDVDPTFFIRLANVSFLDQEDKKDYLKENYHSNYNLFIDKDFNDKTYYDKYPTIYHLRKHLCESKEKEDPRLIYLALHHIVKYRGNFLYEGQKFSMDVSNIEDKMIDVLRQFNEINLFEYVEDRKKIDEVLNVLKEPLSKKHKAEKAFALFDTTKDNKAAYKELCAALAGNKFNVTKMLKEAELHDEDEKDISFKFSDATFDDAFVEKQPLLGDCVEFIDLLHDIYSWVELQNILGSAHTSEPSISAAMIQRYEDHKNDLKLLKDVIRKYLPKKYFEVFRDEKSKKNNYCNYINHPSKTPVDEFYKYIKKLIEKIDDPDVKTILNKIELESFMLKQNSRTNGAVPYQMQLDELNKILENQSVYYSDLKDNEDKIRSILTFRIPYYFGPLNITKDRQFDWIIKKEGKENERILPWNANEIVDVDKTADEFIKRMRNFCTYFPDEPVMAKNSLTVSKYEVLNEINKLRINDHLIKRDMKDKMLHTLFMDHKSISANAMKKWLVKNQYFSNTDDIKIEGFQKENACSTSLTPWIDFTKIFGKINESNYDFIEKIIYDVTVFEDKKILRRRLKKEYDLDEEKIKKILKLKYSGWSRLSKKLLSGIKTKYKDSTRTPETVLEVMERTNMNLMQVINDEKLGFKKTIDDANSTSVSGKFSYAEVQELAGSPAIKRGIWQALLIVDEIKKIMKHEPAHVYIEFARNEDEKERKDSFVNQMLKLYKDYDFEDETEKEANKHLKGEDAKSKIRSERLKLYYTQMGKCMYTGKSLDIDRLDTYQVDHIVPQSLLKDDSIDNKVLVLSSENQRKLDDLVIPSSIRNKMYGFWEKLFNNKIISPKKFYSLIKTEFNEKDQERFINRQIVETRQITKHVAQIIDNHYENTKVVTVRADLSHQFRERYHIYKNRDINDFHHAHDAYIATILGTYIGHRFESLDAKYIYGEYKRIFRNQKNKGKEMKKNNDGFILNSMRNIYADKDTGEIVWDPNYIDRIKKCFYYKDCFVTKKLEENNGTFFNVTVLPNDTNSDKDNTLATVPVNKYRSNVNKYGGFSGVNSFIVAIKGKKKKGKKVIEVNKLTGIPLMYKNADEEIKINYLKQAEDLEEVQIGKEILKNQLIEKDGGLYYIVAPTEIINAKQLILNESQTKLVCEIYKAMKYKNYDNLDSEKIIDLYRLLINKMELYYPEYRKQLVKKFEDRYEQLKVISIEEKCNIIKQILATLHCNSSIGKIMYSDFKISTTIGRLNGRTISLDDISFIAESPTGMYSKKYKL

SEQ ID NO: 136 - protein, 1288 aa, Enterococcus faecalis
MRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKDQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSPTGLYETRRKVVD

SEQ ID NO: 137 - protein, 1052 aa, Staphylococcus aureus
KRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 138 - protein, 1082 aa, Geobacillus thermodenitrificans
MKYKIGLDIGITSIGWAVINLDIPRIEDLGVRIFDRAENPKTGESLALPRRLARSARRRLRRRKHRLERIRRLFVREGILTKEELNKLFEKKHEIDVWQLRVEALDRKLNNDELARILLHLAKRRGFRSNRKSERTNKENSTMLKHIEENQSILSSYRTVAEMVVKDPKFSLHKRNKEDNYTNTVARDDLEREIKLIFAKQREYGNIVCTEAFEHEYISIWASQRPFASKDDIEKKVGFCTFEPKEKRAPKATYTFQSFTVWEHINKLRLVSPGGIRALTDDERRLIYKQAFHKNKITFHDVRTLLNLPDDTRFKGLLYDRNTTLKENEKVRFLELGAYHKIRKAIDSVYGKGAAKSFRPIDFDTFGYALTMFKDDTDIRSYLRNEYEQNGKRMENLADKVYDEELIEELLNLSFSKFGHLSLKALRNILPYMEQGEVYSTACERAGYTFTGPKKKQKTVLLPNIPPIANPVVMRALTQARKVVNAIIKKYGSPVSIHIELARELSQSFDERRKMQKEQEGNRKKNETAIRQLVEYGLTLNPTGLDIVKFKLWSEQNGKCAYSLQPIEIERLLEPGYTEVDHVIPYSRSLDDSYTNKVLVLTKENREKGNRTPAEYLGLGSERWQQFETFVLTNKQFSKKKRDRLLRLHYDENEENEFKNRNLNDTRYISRFLANFIREHLKFADSDDKQKVYTVNGRITAHLRSRWNFNKNREESNLHHAVDAAIVACTTPSDIARVTAFYQRREQNKELSKKTDPQFPQPWPHFADELQARLSKNPKESIKALNLGNYDNEKLESLQPVFVSRMPKRSITGAAHQETLRRYIGIDERSGKIQTVVKKKLSEIQLDKTGHFPMYGKESDPRTYEAIRQRLLEHNNDPKKAFQEPLYKPKKNGELGPIIRTIKIIDTTNQVIPLNDGKTVAYNSNIVRVDVFEKDGKYYCVPIYTIDMMKGILPNKAIEPNKPYSEWKEMTEDYTFRFSLYPNDLIRIEFPREKTIKTAVGEEIKIKDLFAYYQTIDSSNGGLSLVSHDNNFSLRSIGSRTLKRFEKYQVDVLGNIYKVRGEKRVGVASSSHSKAGETIRPL

SEQ ID NO: 139 - protein, 1375 aa, S. canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 140 - protein, 1368 aa, Streptococcus pyogenes
  misc_feature (10)..(10): Xaa can be any naturally occurring amino acid
  misc_feature (840)..(840): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 141 - protein, 1368 aa, Streptococcus pyogenes [sequence omitted]

SEQ ID NO: 142 - protein, 1227 aa, Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVK

SEQ ID NO: 143 - protein, 1368 aa, Streptococcus pyogenes
  misc_feature (10)..(10): Xaa can be any naturally occurring amino acid
MDKKYSIGLXIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 144 - protein, 1368 aa, Streptococcus pyogenes
  misc_feature (762)..(762): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIXMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 145 - protein, 1368 aa, Streptococcus pyogenes
  misc_feature (983)..(983): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHXAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 146 - protein, 1368 aa, Streptococcus pyogenes
  misc_feature (986)..(986): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHXAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 147 - DNA, 10 bp, Artificial Sequence
  Synthetic
cagtgctctg

SEQ ID NO: 148 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIAMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 149 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHAAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 150 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHAAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 151 - protein, 1053 aa, Staphylococcus aureus
MGKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRKLINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYKNDLIKINGELYRVIGVNNDLLNRIEVNMIDITYREYLENMNDKRPPHIIKTIASKTQSIKKYSTDILGNLYEVKSKKHPQIIKK

SEQ ID NO: 152 - protein, 1368 aa, Streptococcus pyogenes
  misc_feature (840)..(840): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 153 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 154 - protein, 1368 aa, Streptococcus pyogenes
  misc_feature (864)..(864): Xaa can be any naturally occurring amino acid
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 155 - protein, 1368 aa, Streptococcus pyogenes
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 156 - protein, 1367 aa, Streptococcus pyogenes
  misc_feature (839)..(839): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDXIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 157 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 158 - protein, 1367 aa, Streptococcus pyogenes
  misc_feature (863)..(863): Xaa can be any naturally occurring amino acid
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNXGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 159 - protein, 1367 aa, Streptococcus pyogenes
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNAGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 160 - protein, 1053 aa, Staphylococcus aureus; identical to SEQ ID NO: 128

SEQ ID NO: 161 - protein, 1082 aa, N. meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDAALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 162 - protein, 984 aa, C. jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 163 - protein, 1087 aa, G. stearothermophilus
MRYKIGLDIGITSVGWAVMNLDIPRIEDLGVRIFDRAENPQTGESLALPRRLARSARRRLRRRKHRLERIRRLVIREGILTKEELDKLFEEKHEIDVWQLRVEALDRKLNNDELARVLLHLAKRRGFKSNRKSERSNKENSTMLKHIEENRAILSSYRTVGEMIVKDPKFALHKRNKGENYTNTIARDDLEREIRLIFSKQREFGNMSCTEEFENEYITIWASQRPVASKDDIEKKVGFCTFEPKEKRAPKATYTFQSFIAWEHINKLRLISPSGARGLTDEERRLLYEQAFQKNKITYHDIRTLLHLPDDTYFKGIVYDRGESRKQNENIRFLELDAYHQIRKAVDKVYGKGKSSSFLPIDFDTFGYALTLFKDDADIHSYLRNEYEQNGKRMPNLANKVYDNELIEELLNLSFTKFGHLSLKALRSILPYMEQGEVYSSACERAGYTFTGPKKKQKTMLLPNIPPIANPVVMRALTQARKVVNAIIKKYGSPVSIHIELARDLSQTFDERRKTKKEQDENRKKNETAIRQLMEYGLTLNPTGHDIVKFKLWSEQNGRCAYSLQPIEIERLLEPGYVEVDHVIPYSRSLDDSYTNKVLVLTRENREKGNRIPAEYLGVGTERWQQFETFVLTNKQFSKKKRDRLLRLHYDENEETEFKNRNLNDTRYISRFFANFIREHLKFAESDDKQKVYTVNGRVTAHLRSRWEFNKNREESDLHHAVDAVIVACTTPSDIAKVTAFYQRREQNKELAKKTEPHFPQPWPHFADELRARLSKHPKESIKALNLGNYDDQKLESLQPVFVSRMPKRSVTGAAHQETLRRYVGIDERSGKIQTVVKTKLSEIKLDASGHFPMYGKESDPRTYEAIRQRLLEHNNDPKKAFQEPLYKPKKNGEPGPVIRTVKIIDTKNQVIPLNDGKTVAYNSNIVRVDVFEKDGKYYCVPVYTMDIMKGILPNKAIEPNKPYSEWKEMTEDYTFRFSLYPNDLIRIELPREKTVKTAAGEEINVKDVFVYYKTIDSANGGLELISHDHRFSLRGVGSRTLKRFEKYQVDVLGNIYKVRGEKRVGLASSAHSKPGKTIRPLQSTRD

SEQ ID NO: 164 - protein, 1228 aa, L. bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 165 - protein, 1108 aa, B. hisashii
MATRSFILKIEPNEEVKKGLWKTHEVLNHGIAYYMNILKLIRQEAIYEHHEQDPKNPKKVSKAEIQAELWDFVLKMQKCNSFTHEVDKDEVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPYTDSNEPIVKEIKWMEKSRNQSVRRLDKDMFIQALERFLSWESWNLKVKEEYEKVEKEYKTLEERIKEDIQALKALEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKVVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKCVTTHADINAAQNLQKRFWTRTHGFYKVYCKAYQVDGQTVYIPESKDQKQKIIEEFGEGYFILKDGVYEWVNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 166 - protein, 1307 aa, Unknown
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 167 - protein, 1307 aa, Unknown
  Acidaminococcus sp. (strain BV3L6)
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMANSNAATGEDYINSPVRDLNGVCFDSRFQNPEWPMDADANGAYHIALKGQLLLNHLKESKDLKLQNGISNQDWLAYIQELRN

SEQ ID NO: 168 - protein, 1259 aa, Lachnospiraceae bacterium
MNYKTGLEDFIGKESLSKTLRNALIPTESTKIHMEEMGVIRDDELRAEKQQELKEIMDDYYRTFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYSVDFYDRELTQPGIEYYNGICGKINEHMNQFCQKNRINKNDFRMKKLHKQILCKKSSYYEIPFRFESDQEVYDALNEFIKTMKKKEIIRRCVHLGQECDDYDLGKIYISSNKYEQISNALYGSWDTIRKCIKEEYMDALPGKGEKKEEKAEAAAKKEEYRSIADIDKIISLYGSEMDRTISAKKCITEICDMAGQISIDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPIVHKKGSVLVNRSYTQTVGNKEIRVSIPEEYYTEIYNYLNHIGKGKLSSEAQRYLDEGKIKSFTATKDIVKNYRYCCDHYFLHLPITINFKAKSDVAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTILASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 169 - protein, 1306 aa, Prevotella copri
MAKNFEDFKRLYSLSKTLRFEAKPIGATLDNIVKSGLLDEDEHRAASYVKVKKLIDEYHKVFIDRVLDDGCLPLENKGNNNSLAEYYESYVSRAQDEDAKKKFKEIQQNLRSVIAKKLTEDKAYANLFGNKLIESYKDKEDKKKIIDSDLIQFINTAESTQLDSMSQDEAKELVKEFWGFVTYFYGFFDNRKNMYTAEEKSTGIAYRLVNENLPKFIDNIEAFNRAITRPEIQENMGVLYSDFSEYLNVESIQEMFQLDYYNMLLTQKQIDVYNAIIGGKTDDEHDVKIKGINEYINLYNQQHKDDKLPKLKALFKQILSDRNAISWLPEEFNSDQEVLNAIKDCYERLAENVLGDKVLKSLLGSLADYSLDGIFIRNDLQLTDISQKMFGNWGVIQNAIMQNIKRVAPARKHKESEEDYEKRIAGIFKKADSFSISYINDCLNEADPNNAYFVENYFATFGAVNTPTMQRENLFALVQNAYTEVAALLHSDYPTVKHLAQDKANVSKIKALLDAIKSLQHFVKPLLGKGDESDKDERFYGELASLWAELDTVTPLYNMIRNYMTRKPYSQKKIKLNFENPQLLGGWDANKEKDYATIILRRNGLYYLAIMDKDSRKLLGKAMPSDGECYEKMVYKFFKDVTTMIPKCSTQLKDVQAYFKVNTDDYVLNSKAFNKPLTITKEVFDLNNVLYGKYKKFQKGYLTATGDNVGYTHAVNVWIKFCMDFLNSYDSTCIYDFSSLKPESYLSLDAFYQDANLLLYKLSFARASVSYINQLVEEGKMYLFQIYNKDFSEYSKGTPNMHTLYWKALFDERNLADVVYKLNGQAEMFYRKKSIENTHPTHPANHPILNKNKDNKKKESLFDYDLIKDRRYTVDKFMFHVPITMNFKSVGSENINQDVKAYLRHADDMHIIGIDRGERHLLYLVVIDLQGNIKEQYSLNEIVNEYNGNTYHTNYHDLLDVREEERLKARQSWQTIENIKELKEGYLSQVIHKITQLMVRYHAIVVLEDLSKGFMRSRQKVEKQVYQKFEKMLIDKLNYLVDKKTDVSTPGGLLNAYQLTCKSDSSQKLGKQSGFLFYIPAWNTSKIDPVTGFVNLLDTHSLNSKEKIKAFFSKFDAIRYNKDKKWFEFNLDYDKFGKKAEDTRTKWTLCTRGMRIDTFRNKEKNSQWDNQEVDLTTEMKSLLEHYYIDIHGNLKDAISAQTDKAFFTGLLHILKLTLQMRNSITGTETDYLVSPVADENGIFYDSRSCGNQLPENADANGAYNIARKGLMLIEQIKNAEDLNNVKFDISNKAWLNFAQQKPYKNG

SEQ ID NO: 170 - protein, 1142 aa, Eubacterium rectale
MFSAKLISDILPEFVIHNNNYSASEKEEKTQVIKLFSRFATSFKDYFKNRANCFSANDISSSSCHRIVNDNAEIFFSNALVYRRIVKNLSNDDINKISGDMKDSLKEMSLEEIYSYEKYGEFITQEGISFYNDICGKVNLFMNLYCQKNKENKNLYKLRKLHKQILCIADTSYEVPYKFESDEEVYQSVNGFLDNISSKHIVERLRKIGENYNGYNLDKIYIVSKFYESVSQKTYRDWETINTALEIHYNNILPGNGKSKADKVKKAVKNDLQKSITEINELVSNYKLCPDDNIKAETYIHEISHILNNFEAQELKYNPEIHLVESELKASELKNVLDVIMNAFHWCSVFMTEELVDKDNNFYAELEEIYDEIYPVISLYNLVRNYVTQKPYSTKKIKLNFGIPTLADGWSKSKEYSNNAIILMRDNLYYLGIFNAKNKPDKKIIEGNTSENKGDYKKMIYNLLPGPNKMIPKVFLSSKTGVETYKPSAYILEGYKQNKHLKSSKDFDITFCHDLIDYFKNCIAIHPEWKNFGFDFSDTSTYEDISGFYREVELQGYKIDWTYISEKDIDLLQEKGQLYLFQIYNKDFSKKSSGNDNLHTMYLKNLFSEENLKDIVLKLNGEAEIFFRKSSIKNPIIHKKGSILVNRTYEAEEKDQFGNIQIVRKTIPENIYQELYKYFNDKSDKELSDEAAKLKNVVGHHEAATNIVKDYRYTYDKYFLHMPITINFKANKTSFINDRILQYIAKEKDLHVIGIDRGERNLIYVSVIDTCGNIVEQKSFNIVNGYDYQIKLKQQEGARQIARKEWKEIGKIKEIKEGYLSLVIHEISKMVIKYNAIIAMEDLSYGFKKGRFKVERQVYQKFETMLINKLNYLVFKDISITENGGLLKGYQLTYIPDKLKNVGHQCGCIFYVPAAYTSKIDPTTGFVNIFKFKDLTVDAKREFIKKFDSIRYDSDKNLFCFTFDYNNFITQNTVMSKSSWSVYTYGVRIKRRFVNGRFSNESDTIDITKDMEKTLEMTDINWRDGHDLRQDIIDYEIVQHIFEIFKLTVQMRNSLSELEDRDYDRLISPVLNENNIFYDSAKAGDALPKDADANGAYCIALKGLYEIKQITENWKEDGKFSRDKLKISNKDWFDFIQNKRYL

SEQ ID NO: 171 - protein, 1259 aa, Unknown
  Clostridium sp. AF34-10BH
MNYKTGLEDFIGKESLSKTLRNALIPTESTKIHMEEMGVIRDDELRAEKQQELKEIMDDYYRAFIEEKLGQIQGIQWNSLFQKMEETMEDISVRKDLDKIQNEKRKEICCYFTSDKRFKDLFNAKLITDILPNFIKDNKEYTEEEKAEKEQTRVLFQRFATAFTNYFNQRRNNFSEDNISTAISFRIVNENSEIHLQNMRAFQRIEQQYPEEVCGMEEEYKDMLQEWQMKHIYLVDFYDRVLTQPGIEYYNGICGKINEHMNQFCQKNRINKNDFRMKKLHKQILCKKSSYYEIPFRFESDQEVYDALNEFIKTMKEKEIICRCVHLGQKCDDYDLGKIYISSNKYEQISNALYGSWDTIRKCIKEEYMDALPGKGEKKEEKAEAAAKKEEYRSIADIDKIISLYGSEMDRTISAKKCITEICDMAGQISTDPLVCNSDIKLLQNKEKTTEIKTILDSFLHVYQWGQTFIVSDIIEKDSYFYSELEDVLEDFEGITTLYNHVRSYVTQKPYSTVKFKLHFGSPTLANGWSQSKEYDNNAILLMRDQKFYLGIFNVRNKPDKQIIKGHEKEEKGDYKKMIYNLLPGPSKMLPKVFITSRSGQETYKPSKHILDGYNEKRHIKSSPKFDLGYCWDLIDYYKECIHKHPDWKNYDFHFSDTKDYEDISGFYREVEMQGYQIKWTYISADEIQKLDEKGQIFLFQIYNKDFSVHSTGKDNLHTMYLKNLFSEENLKDIVLKLNGEAELFFRKASIKTPVVHKKGSVLVNRSYTQTVGDKEIRVSIPEEYYTEIYNYLNHIGRGKLSTEAQRYLEERKIKSFTATKDIVKNYRYCCDHYFLHLPITINFKAKSDIAVNERTLAYIAKKEDIHIIGIDRGERNLLYISVVDVHGNIREQRSFNIVNGYDYQQKLKDREKSRDAARKNWEEIEKIKELKEGYLSMVIHYIAQLVVKYNAVVAMEDLNYGFKTGRFKVERQVYQKFETMLIEKLHYLVFKDREVCEEGGVLRGYQLTYIPESLKKVGKQCGFIFYVPAGYTSKIDPTTGFVNLFSFKNLTNRESRQDFVGKFDEIRYDRDKKMFEFSFDYNNYIKKGTMLASTKWKVYTNGTRLKRIVVNGKYTSQSMEVELTDAMEKMLQRAGIEYHDGKDLKGQIVEKGIEAEIIDIFRLTVQMRNSRSESEDREYDRLISPVLNDKGEFFDTATADKTLPQDADANGAYCIALKGLYEVKQIKENWKENEQFPRNKLVQDNKTWFDFMQKKRYL

SEQ ID NO: 172 - protein, 1108 aa, Bacillus hisashii; identical to SEQ ID NO: 165

SEQ ID NO: 173 - protein, 1465 aa, Thermomonas hydrothermalis
MSEKTTQRAYTLRLNRASGECAVCQNNSCDCWHDALWATHKAVNRGAKAFGDWLLTLRGGLCHTLVEMEVPAKGNNPPQRPTDQERRDRRVLLALSWLSVEDEHGAPKEFIVATGRDSADDRAKKVEEKLREILEKRDFQEHEIDAWLQDCGPSLKAHIREDAVWVNRRALFDAAVERIKTLTWEEAWDFLEPFFGTQYFAGIGDGKDKDDAEGPARQGEKAKDLVQKAGQWLSARFGIGTGADFMSMAEAYEKIAKWASQAQNGDNGKATIEKLACALRPSEPPTLDTVLKCISGPGHKSATREYLKTLDKKSTVTQEDLNQLRKLADEDARNCRKKVGKKGKKPWADEVLKDVENSCELTYLQDNSPARHREFSVMLDHAARRVSMAHSWIKKAEQRRRQFESDAQKLKNLQERAPSAVEWLDRFCESRSMTTGANTGSGYRIRKRAIEGWSYVVQAWAEASCDTEDKRIAAARKVQADPEIEKFGDIQLFEALAADEAICVWRDQEGTQNPSILIDYVTGKTAEHNQKRFKVPAYRHPDELRHPVFCDFGNSRWSIQFAIHKEIRDRDKGAKQDTRQLQNRHGLKMRLWNGRSMTDVNLHWSSKRLTADLALDQNPNPNPTEVTRADRLGRAASSAFDHVKIKNVFNEKEWNGRLQAPRAELDRIAKLEEQGKTEQAEKLRKRLRWYVSFSPCLSPSGPFIVYAGQHNIQPKRSGQYAPHAQANKGRARLAQLILSRLPDLRILSVDLGHRFAAACAVWETLSSDAFRREIQGLNVLAGGSGEGDLFLHVEMTGDDGKRRTVVYRRIGPDQLLDNTPHPAPWARLDRQFLIKLQGEDEGVREASNEELWTVHKLEVEVGRTVPLIDRMVRSGFGKTEKQKERLKKLRELGWISAMPNEPSAETDEKEGEIRSISRSVDELMSSALGTLRLALKRHGNRARIAFAMTADYKPMPGGQKYYFHEAKEASKNDDETKRRDNQIEFLQDALSLWHDLFSSPDWEDNEAKKLWQNHIATLPNYQTPEEISAELKRVERNKKRKENRDKLRTAAKALAENDQLRQHLHDTWKERWESDDQQWKERLRSLKDWIFPRGKAEDNPSIRHVGGLSITRINTISGLYQILKAFKMRPEPDDLRKNIPQKGDDELENFNRRLLEARDRLREQRVKQLASRIIEAALGVGRIKIPKNGKLPKRPRTTVDTPCHAVVIESLKTYRPDDLRTRRENRQLMQWSSAKVRKYLKEGCELYGLHFLEVPANYTSRQCSRTGLPGIRCDDVPTGDFLKAPWWRRAINTAREKNGGDAKDRFLVDLYDHLNNLQSKGEALPATVRVPRQGGNLFIAGAQLDDTNKERRAIQADLNAAANIGLRALLDPDWRGRWWYVPCKDGTSEPALDRIEGSTAFNDVRSLPTGDNSSRRAPREIENLWRDPSGDSLESGTWSPTRAYWDTVQSRVIELLRRHAGLPTS

SEQ ID NO: 174 - protein, 1090 aa, Laceyella sacchari
MSIRSFKLKLKTKSGVNAEQLRRGLWRTHQLINDGIAYYMNWLVLLRQEDLFIRNKETNEIEKRSKEEIQAVLLERVHKQQQRNQWSGEVDEQTLLQALRQLYEEIVPSVIGKSGNASLKARFFLGPLVDPNNKTTKDVSKSGPTPKWKKMKDAGDPNWVQEYEKYMAERQTLVRLEEMGLIPLFPMYTDEVGDIHWLPQASGYTRTWDRDMFQQAIERLLSWESWNRRVRERRAQFEKKTHDFASRFSESDVQWMNKLREYEAQQEKSLEENAFAPNEPYALTKKALRGWERVYHSWMRLDSAASEEAYWQEVATCQTAMRGEFGDPAIYQFLAQKENHDIWRGYPERVIDFAELNHLQRELRRAKEDATFTLPDSVDHPLWVRYEAPGGTNIHGYDLVQDTKRNLTLILDKFILPDENGSWHEVKKVPFSLAKSKQFHRQVWLQEEQKQKKREVVFYDYSTNLPHLGTLAGAKLQWDRNFLNKRTQQQIEETGEIGKVFFNISVDVRPAVEVKNGRLQNGLGKALTVLTHPDGTKIVTGWKAEQLEKWVGESGRVSSLGLDSLSEGLRVMSIDLGQRTSATVSVFEITKEAPDNPYKFFYQLEGTEMFAVHQRSFLLALPGENPPQKIKQMREIRWKERNRIKQQVDQLSAILRLHKKVNEDERIQAIDKLLQKVASWQLNEEIATAWNQALSQLYSKAKENDLQWNQAIKNAHHQLEPVVGKQISLWRKDLSTGRQGIAGLSLWSIEELEATKKLLTRWSKRSREPGVVKRIERFETFAKQIQHHINQVKENRLKQLANLIVMTALGYKYDQEQKKWIEVYPACQVVLFENLRSYRFSFERSRRENKKLMEWSHRSIPKLVQMQGELFGLQVADVYAAYSSRYHGRTGAPGIRCHALTEADLRNETNIIHELIEAGFIKEEHRPYLQQGDLVPWSGGELFATLQKPYDNPRILTLHADINAAQNIQKRFWHPSMWFRVNCESVMEGEIVTYVPKNKTVHKKQGKTFRFVKVEGSDVYEWAKWSKNRNKNTFSSITERKPPSSMILFRDPSGTFFKEQEWVEQKTFWGKVQSMIQAYMKKTIVQRMEE

SEQ ID NO: 175 - protein, 1194 aa, Dsulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 176 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTAAYSVLVVAKVEKGKSKKLKSVKELLGITIMERSSFEKNPIGFLEAKGYKEVKKDLIIKLPKYSLFELENGRKRMLASAGVLHKGNELALPSKYVNFLYLASHYEKLKGSPEDNEQKQLFVEQHKHYLDEIIEQISEFSKRVILADANLDKVLSAYNKHRDKPIREQAENIIHLFTLTNLGVPAAFKYFDTTIDKKRYTSTKEVLDATLIHQSITGLYETRIDLSQLGGD

SEQ ID NO: 177 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIDFLEAKGYKEVKKDLIIKLPKYSLFELENGRKRMLASAGVLQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTINRKQYNTTKEVLDATLIRQSITGLYETRIDLSQLGGD

SEQ ID NO: 178 - protein, 1368 aa, Artificial Sequence
  Synthetic
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMVKRYDEHHQDLTLLKALVRQQLPEKYKEIFFDQSKNGYAGYIDGGASQEEFYKFIKPILEKMDGTEELLVKLNREDLLRKQRTFDNGIIPHQIHLGELHAILRRQGDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRLRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKGNSDKLIARKKDWDPKKYGGFNSPTVAYSVLVVAKVEKGKSKKLKSVKELLGITIMERSSFEKNPIGFLEAKGYKEVKKDLIIKLPKYSLFELENGRKRMLASASVLHKGNELALPSKYVNFLYLASHYEKLKGSSEDNKQKQLFVEQHKHYLDEIIEQISEFSKRVILADANLDKVLSAYNKHRDKPIREQAENIIHLFTLTNLGASAAFKYFDTTIGRKLYTSTKEVLDATLIHQSITGLYETRIDLSQLGGD

SEQ ID NO: 179 - protein, 1359 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRKLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLKREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 180 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 181 - protein, 1082 aa, Geobacillus thermodenitrificans; identical to SEQ ID NO: 138

SEQ ID NO: 182 - protein, 887 aa, Natronobacterium gregoryi
MTVIDLDSTTTADELTSGHTYDISVTLTGVYDNTDEQHPRMSLAFEQDNGERRYITLWKNTTPKDVFTYDYATGSTYIFTNIDYEVKDGYENLTATYQTTVENATAQEVGTTDEDETFAGGEPLDHHLDDALNETPDDAETESDSGHVMTSFASRDQLPEWTLHTYTLTATDGAKTDTEYARRTLAYTVRQELYTDHDAAPVATDGLMLLTPEPLGETPLDLDCGVRVEADETRTLDYTTAKDRLLARELVEEGLKRSLWDDYLVRGIDEVLSKEPVLTCDEFDLHERYDLSVEVGHSGRAYLHINFRHRFVPKLTLADIDDDNIYPGLRVKTTYRPRRGHIVWGLRDECATDSLNTLGNQSVVAYHRNNQTPINTDLLDAIEAADRRVVETRRQGHGDDAVSFPQELLAVEPNTHQIKQFASDGFHQQARSKTRLSASRCSEKAQAFAERLDPVRLNGSTVEFSSEFFTGNNEQQLRLLYENGESVLTFRDGARGAHPDETFSKGIVNPPESFEVAVVLPEQQADTCKAQWDTMADLLNQAGAPPTRSETVQYDAFSSPESISLNVAGAIDPSEVDAAFVVLPPDQEGFADLASPTETYDELKKALANMGIYSQMAYFDRFRDAKIFYTRNVALGLLAAAGGVAFTTEHAMPGDADMFIGIDVSRSYPEDGASGQINIAATATAVYKDGTILGHSSTRPQLGEKLQSTDVRDIMKNAILGYQQVTGESPTHIVIHRDGFMNEDLDPATEFLNEQGVEYDIVEIRKQPQTRLLAVSDVQYDTPVKSIAAINQNEPRATVATFGAPEYLATRDGGGLPRPIQIERVAGETDIETLTRQVYLLSQSHIQVHNSTARLPITTAYADQASTHATKGYLVQTGAFESNVGFL

SEQ ID NO: 183 - protein, 1387 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYG

SEQ ID NO: 184 - protein, 1388 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQ

SEQ ID NO: 185 - protein, 1387 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYS

SEQ ID NO: 186 - protein, 1388 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGSGGSGGSGGSGGSGGSGGMDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGS

SEQ ID NO: 187 - protein, 1387 aa, Artificial Sequence
  Synthetic
KPIREQAENIIHLFTLTNLGAPAAFKYFDTTIDRKRYTSTKEVLDATLIHQSITGLYETRIDLSQLGGDGGSGGSGGSGGSGGSGGSGGDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRD

SEQ ID NO: 188 - protein, 357 aa, Artificial Sequence
  Synthetic
DYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 189 - protein, 341 aa, Artificial Sequence
  Synthetic
EIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 190 - protein, 328 aa, Artificial Sequence
  Synthetic
NIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 191 - protein, 120 aa, Artificial Sequence
  Synthetic
PEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 192 - protein, 69 aa, Artificial Sequence
  Synthetic
KPIREQAENIIHLFTLTNLGAPAAFKYFDTTIDRKRYTSTKEVLDATLIHQSITGLYETRIDLSQLGGD

SEQ ID NO: 193 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKQYRSTKEVLDATLIHQSITGLYETRIDLSQLGGD

SEQ ID NO: 194 - protein, 1367 aa, Artificial Sequence
  Synthetic
DKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFVSPTVAYSVLVVAKVEKGKSKKLKSVKELLGITIMERSSFEKNPIDFLEAKGYKEVKKDLIIKLPKYSLFELENGRKRMLASARELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKEYRSTKEVLDATLIHQSITGLYETRIDLSQLGGD

SEQ ID NO: 195 - RNA, 91 nt, Artificial Sequence
  Synthetic
guuuuaguacucuguaaugaaaauuacagaaucuacuaaaacaaggcaaaaugccguguuuaucucgucaacuuguuggcgagauuuuuuu

SEQ ID NO: 196 - protein, 23 aa, Artificial Sequence
  Synthetic
MMMMMMMMNNNNNNNNNNNNNGG

SEQ ID NO: 197 - protein, 15 aa, Artificial Sequence
  Synthetic
NNNNNNNNNNNNNGG

SEQ ID NO: 198 - protein, 23 aa, Artificial Sequence
  Synthetic
MMMMMMMMMNNNNNNNNNNNNGG

SEQ ID NO: 199 - protein, 14 aa, Artificial Sequence
  Synthetic
NNNNNNNNNNNNGG

SEQ ID NO: 200 - protein, 27 aa, Artificial Sequence
  Synthetic
MMMMMMMMNNNNNNNNNNNNNNAGAAW

SEQ ID NO: 201 - protein, 19 aa, Artificial Sequence
  Synthetic
NNNNNNNNNNNNNNAGAAW

SEQ ID NO: 202 - protein, 27 aa, Artificial Sequence
  Synthetic
MMMMMMMMMNNNNNNNNNNNNNAGAAW

SEQ ID NO: 203 - protein, 18 aa, Artificial Sequence
  Synthetic
NNNNNNNNNNNNNAGAAW

SEQ ID NO: 204 - protein, 25 aa, Artificial Sequence
  Synthetic
MMMMMMMMNNNNNNNNNNNNNGGNG

SEQ ID NO: 205 - protein, 17 aa, Artificial Sequence
  Synthetic
NNNNNNNNNNNNNGGNG

SEQ ID NO: 206 - protein, 25 aa, Artificial Sequence
  Synthetic
MMMMMMMMMNNNNNNNNNNNNGGNG

SEQ ID NO: 207 - protein, 16 aa, Artificial Sequence
  Synthetic
NNNNNNNNNNNNGGNG

SEQ ID NO: 208 - DNA, 125 bp, Artificial Sequence
  Synthetic
  misc_feature (1)..(8): n is a, c, g, or t
nnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 209 - DNA, 121 bp, Artificial Sequence
  Synthetic
  misc_feature (1)..(18): n is a, c, g, or t
nnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 210 - DNA, 109 bp, Artificial Sequence
  Synthetic
  misc_feature (1)..(20): n is a, c, g, or t
nnnnnnnnnnnnnnnnnnnngtttttgtactctcagaaatgcagaagctacaaagataaggcttcatgccgaaatcaacaccctgtcattttatggcagggtgtttttt

SEQ ID NO: 211 - DNA, 102 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtggcaccgagtcggtgctttttt

SEQ ID NO: 212 - DNA, 88 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcaacttgaaaaagtgttttttt

SEQ ID NO: 213 - DNA, 76 bp, Artificial Sequence
  Synthetic
  misc_feature (1)..(20): n is a, c, g, or t
nnnnnnnnnnnnnnnnnnnngttttagagctagaaatagcaagttaaaataaggctagtccgttatcatttttttt

SEQ ID NO: 214 - RNA, 81 nt, Artificial Sequence
  Synthetic
guuuuagagcuagaaauagcaaguuaaaauaaggcuaguccguuaucaacuugaaaaaguggcaccgagucggugcuuuuu

SEQ ID NO: 215 - protein, 1775 aa, Artificial Sequence
  Synthetic
MSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 216 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 217 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 218 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGQRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 219 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGFRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 220 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGMRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 221 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRWAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 222 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNQAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 223 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNFAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 224 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNWAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 225 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNMAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 226 - protein, 1775 aa, artificial Sequence
  Synthetic
MSEVEFSHEYWMRHALTLAKRAWDEREVPVGAVLVHNNRVIGEGWNRPIGRHDPTAHAQIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGWRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 227 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNQAIGLHDPTAHAEIMALRQGGLVMQNYRLIDATLYVTFEPCVMCAGAMIHSRIGRVVFGVRWAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 228 - protein, 1775 aa, artificial Sequence
  Synthetic
MSEVEFSHEYWMRHALTLAKRAWDEREVPVGAVLVHNNRVIGEGWNRPIGRHDPTAHAAIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNQAIGLHDPTAHAEIMALRQGGLVMQNYRLIDATLYVTFEPCVMCAGAMIHSRIGRVVFGWRNAKTGAAGSLMDVLHYPGMNHRVEITEGILADECAALLCYFFRMPRQVFNAQKKAQSSTDSGGSSGGSSGSETPGTSESATPESSGGSSGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDSGGSPKKKRKV

SEQ ID NO: 229 - protein, 124 aa, artificial Sequence
  Synthetic
  misc_feature (5)..(124): may be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 230 - protein, 124 aa, artificial Sequence
  Synthetic
  misc_feature (5)..(124): may be absent
GGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGSGGGS

SEQ ID NO: 231 - protein, 155 aa, artificial Sequence
  Synthetic
  misc_feature (6)..(155): may be absent
GGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGSGGGGS

SEQ ID NO: 232 - protein, 31 aa, artificial Sequence
  Synthetic
  misc_feature (2)..(31): may be absent
GGGGGGGGGGGGGGGGGGGGGGGGGGGGGGG

SEQ ID NO: 233 - protein, 155 aa, artificial Sequence
  Synthetic
  misc_feature (6)..(155): may be absent
EAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAKEAAAK

SEQ ID NO: 234 - protein, 264 aa, Artificial Sequence
  Synthetic
  misc_feature (5)..(124): may be absent
  misc_feature (141)..(264): may be absent
SGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGSETPGTSESATPESSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGSSGGS

SEQ ID NO: 235 - protein, 93 aa, artificial Sequence
  Synthetic
  misc_feature (4)..(93): may be absent
GGSGGSGGSGGSGGSGGSGGSGGSGGSGGSGGSGGSGGSGGSGGSGGSGGSGGSGGSGGSGGSGGSGGSGGSGGSGGSGGSGGSGGSGGSGGS

SEQ ID NO: 236 - protein, 16 aa, artificial Sequence
  Synthetic
SGSETPGTSESATPES

SEQ ID NO: 237 - protein, 62 aa, artificial Sequence
  Synthetic
  misc_feature (1)..(1): Xaa can be any naturally occurring amino acid
  misc_feature (3)..(62): may be absent
XPXPXPXPXPXPXPXPXPXPXPXPXPXPXPXPXPXPXPXPXPXPXPXPXPXPXPXPXPXPXP

SEQ ID NO: 238 - protein, 24 aa, artificial Sequence
  Synthetic
SGGSSGSETPGTSESATPESSGGS

SEQ ID NO: 239 - protein, 32 aa, artificial Sequence; identical to SEQ ID NO: 112
  Synthetic

SEQ ID NO: 240 - protein, 104 aa, artificial Sequence
  Synthetic
GGSGGSPGSPAGSPTSTEEGTSESATPESGPGTSTEPSEGSAPGSPAGSPTSTEEGTSTEPSEGSAPGTSTEPSEGSAPGTSESATPESGPGSEPATSGGSGGS

SEQ ID NO: 241 - protein, 24 aa, artificial Sequence
  Synthetic
SGGSSGGSSGSETPGTSESATPES

SEQ ID NO: 242 - protein, 40 aa, artificial Sequence
  Synthetic
SGGSSGGSSGSETPGTSESATPESSGGSSGGSSGGSSGGS

SEQ ID NO: 243 - protein, 64 aa, artificial Sequence
  Synthetic
SGGSSGGSSGSETPGTSESATPESSGGSSGGSSGGSSGGSSGSETPGTSESATPESSGGSSGGS

SEQ ID NO: 244 - protein, 92 aa, artificial Sequence
  Synthetic
PGSPAGSPTSTEEGTSESATPESGPGTSTEPSEGSAPGSPAGSPTSTEEGTSTEPSEGSAPGTSTEPSEGSAPGTSESATPESGPGSEPATS

SEQ ID NO: 245 - protein, 24 aa, artificial Sequence
  Synthetic
  misc_feature (4)..(24): may be absent
GGSGGSGGSGGSGGSGGSGGSGGS

SEQ ID NO: 246 - protein, 23 aa, artificial Sequence
  Synthetic
TATATGCATATTTATTACATCGG

SEQ ID NO: 247 - protein, 23 aa, artificial Sequence
  Synthetic
CCGTCATGTGGGTCCTGAATTGG

SEQ ID NO: 248 - protein, 23 aa, artificial Sequence
  Synthetic
ACACTGAAAGACTCCAGGTCAGG

SEQ ID NO: 249 - protein, 23 aa, artificial Sequence
  Synthetic
GTCAGAAGAGATGTGGTCAATGG

SEQ ID NO: 250 - protein, 23 aa, artificial Sequence
  Synthetic
TTTAAAGTGAAGCAGCATCTGGG

SEQ ID NO: 251 - protein, 23 aa, artificial Sequence
  Synthetic
ATTTAAAGTGAAGCAGCATCTGG

SEQ ID NO: 252 - protein, 23 aa, artificial Sequence
  Synthetic
ACTCCATGACAGTGTAATTTTGG

SEQ ID NO: 253 - protein, 23 aa, artificial Sequence
  Synthetic
GCCTGGAGAAGCCATCCAGCAGG

SEQ ID NO: 254 - protein, 23 aa, artificial Sequence
  Synthetic
CTCAGACACACTCATTGATGAGG

SEQ ID NO: 255 - protein, 24 aa, artificial Sequence
  Synthetic
GAGGCACTGCCCCCACCATGAGCG

SEQ ID NO: 256 - protein, 117 aa, Artificial Sequence
  Synthetic
  misc_feature (2)..(11): Xaa can be any naturally occurring amino acid
  misc_feature (13)..(14): Xaa can be any naturally occurring amino acid
  misc_feature (16)..(17): Xaa can be any naturally occurring amino acid
  misc_feature (19)..(25): Xaa can be any naturally occurring amino acid
  misc_feature (27)..(27): Xaa can be any naturally occurring amino acid
  misc_feature (29)..(29): Xaa can be any naturally occurring amino acid
  misc_feature (31)..(34): Xaa can be any naturally occurring amino acid
  misc_feature (36)..(38): Xaa can be any naturally occurring amino acid
  misc_feature (40)..(43): Xaa can be any naturally occurring amino acid
  misc_feature (45)..(54): Xaa can be any naturally occurring amino acid
  misc_feature (58)..(70): Xaa can be any naturally occurring amino acid
  misc_feature (73)..(75): Xaa can be any naturally occurring amino acid
  misc_feature (78)..(78): Xaa can be any naturally occurring amino acid
  misc_feature (81)..(81): Xaa can be any naturally occurring amino acid
  misc_feature (85)..(85): Xaa can be any naturally occurring amino acid
  misc_feature (88)..(88): Xaa can be any naturally occurring amino acid
  misc_feature (90)..(94): Xaa can be any naturally occurring amino acid
  misc_feature (96)..(98): Xaa can be any naturally occurring amino acid
  misc_feature (100)..(101): Xaa can be any naturally occurring amino acid
  misc_feature (103)..(104): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(113): Xaa can be any naturally occurring amino acid
  misc_feature (115)..(117): Xaa can be any naturally occurring amino acid
  misc_feature (119)..(123): Xaa can be any naturally occurring amino acid
  misc_feature (126)..(131): Xaa can be any naturally occurring amino acid
  misc_feature (133)..(133): Xaa can be any naturally occurring amino acid
  misc_feature (135)..(137): Xaa can be any naturally occurring amino acid
  misc_feature (139)..(144): Xaa can be any naturally occurring amino acid
  misc_feature (146)..(149): Xaa can be any naturally occurring amino acid
  misc_feature (151)..(164): Xaa can be any naturally occurring amino acid
MXXXXXXXXXXMXXAXXAXXXXXXXEXPXGXXXXBXXXIXXXXNXXXXXXXXXXHAEXXXXXXXXXXXXXRLXXXTLXVTXEPCXMCXGXXXXXRXXXVXXGAXDXKXGXXXXLXXX

SEQ ID NO: 257 - protein, 31 aa, B. subtilis
MAAEPGINHAERLTLVTEPCMCGRVGADKGL

SEQ ID NO: 258 - protein, 31 aa, S. aureus; identical to SEQ ID NO: 257

SEQ ID NO: 259 - protein, 32 aa, S. pyogenes
MMAAEPGINHAERLTLVTEPCMCGRVGANKGL

What is claimed is:

1. A fusion protein comprising a first adenosine deaminase and a second adenosine deaminase, wherein the first adenosine deaminase (a) is catalytically inactive, or (b) has decreased adenosine deaminase activity as compared to the second adenosine deaminase;

wherein the first adenosine deaminase comprises an amino acid sequence that is at least 80% identical to the amino acid sequence of any one of SEQ ID NOs: 86-94, and wherein the first adenosine deaminase comprises any amino acid residue except for E in a position that corresponds to position 59 of SEQ ID NO: 86; and wherein the second adenosine deaminase comprises an amino acid sequence that is at least 80% identical to the amino acid sequence of any one of SEQ ID NOs: 86-94, 96 and 110, wherein the second adenosine deaminase comprises any amino acid residue except for A, V, or T, in a position that corresponds to position 106 of SEQ ID NO: 86.

2. The fusion protein of claim 1, wherein the first and/or the second adenosine deaminase is capable of deaminating adenine of a deoxyadenosine in deoxyribonucleic acid (DNA).

3. The fusion protein of claim 1, wherein the first and/or second adenosine deaminase is a TadA deaminase derived from an *E. coli, S. aureus, B. subtilis, S. typhimurim, S. putrefaciens, H. influenza, C. crescentus*, or a *G. sulfurreducens* bacterium.

4. The fusion protein of claim 1, wherein the first adenosine deaminase comprises an A in a position that corresponds to position 59 of SEQ ID NO: 86.

5. The fusion protein of claim 1, wherein the first adenosine deaminase comprises the amino acid sequence of SEQ ID NO: 95 or 107.

6. The fusion protein of claim 1, wherein the second adenosine deaminase comprises an amino acid sequence that is at least 85%, 90%, 95%, 98%, 99%, or 99.5% identical to the amino acid sequence of any one of SEQ ID NOs: 86-94, 96, and 110, with the exception of an amino acid substitution to a residue other than A, V, and T in position 106 of the amino acid sequence of SEQ ID NO: 86 or in a position in the amino acid sequence of any one of SEQ ID NOs: 86-94, 96, and 110 that corresponds to position 106 of SEQ ID NO: 86.

7. The fusion protein of claim 6, wherein the second adenosine deaminase comprises a Q, F, W, or M in a position that corresponds to position 106 of SEQ ID NO: 86.

8. The fusion protein of claim 6, wherein the second adenosine deaminase comprises a W in a position that corresponds to position 106 of SEQ ID NO: 86.

9. The fusion protein of claim 1, wherein the second adenosine deaminase comprises a Q, F, W, K, or M in a position that corresponds to position 108 of SEQ ID NO: 86.

10. The fusion protein of claim 1, wherein the fusion protein further comprises a nucleic acid programmable DNA binding protein (napDNAbp) domain.

11. The fusion protein of claim 10, wherein the napDNAbp domain is a nuclease dead Cas9 (dCas9), a Cas9 nickase (nCas9), or a nuclease active Cas9.

12. The fusion protein of claim 1 further comprising one or more nuclear localization sequences (NLS).

13. The fusion protein of claim 10, wherein the fusion protein comprises the structure: $NH_2$-[first adenosine deaminase]-[second adenosine deaminase]-[napDNAbp domain]-COOH; $NH_2$-[second adenosine deaminase]-[first adenosine deaminase]-[napDNAbp domain]-COOH; $NH_2$-[napDNAbp domain]-[first adenosine deaminase]-[second adenosine deaminase]-COOH; $NH_2$-[napDNAbp domain]-[second adenosine deaminase]-[first adenosine deaminase]-COOH; $NH_2$-[first adenosine deaminase]-[napDNAbp domain]-[second adenosine deaminase]-COOH; or $NH_2$-[second adenosine deaminase]-[napDNAbp domain]-[first adenosine deaminase]-COOH, wherein each "]-[" in the structure indicates the optional presence of a linker sequence.

14. The fusion protein of claim 1, wherein the fusion protein comprises an amino acid sequence that is at least 85% identical to any one of the amino acid sequences of SEQ ID NOs: 216-228.

15. The fusion protein of claim 1, wherein the fusion protein comprises any one of the amino acid sequences of SEQ ID NOs: 216-228.

16. A complex comprising the fusion protein of claim 10 and a guide RNA bound to the napDNAbp domain of the fusion protein.

17. A method comprising contacting a nucleic acid molecule with the fusion protein of claim 10 and a guide RNA, wherein the guide RNA is between 15 and 100 nucleotides long and comprises a sequence of at least 10 contiguous nucleotides that is complementary to a target sequence.

18. A polynucleotide encoding the fusion protein of claim 1.

19. A vector comprising the polynucleotide of claim 18.

20. A cell comprising the fusion protein of claim 1.

21. The fusion protein of claim 1, wherein the second adenosine deaminase comprises the amino acid sequence of any one of SEQ ID NOs: 97-106.

22. The fusion protein of claim 1, wherein the second adenosine deaminase further comprises a Q, F, W, or M in a position that corresponds to position 47 of SEQ ID NO: 86.

* * * * *